United States Patent 10,947,534 (RNA-GUIDED DNA INTEGRATION USING TN7-LIKE TRANSPOSONS) - sequence listing, part 2

SEQ ID NO: 900 - DNA, 14431 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaactaccgagcgcagcgagtcagtgagcgaggacacagggcatccagctcattgggggcgacggtcaattaagtccagtcatagtgggactggtgtcctaataatttaagcattcttttctagaaatactttgtctttccttgactttcatcagggtggttgttatattagtaattgtgttagcactccattaagttaagtgctaaaaagaggtgagcggtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 901 - DNA, 14415 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaactaccgagcgcagcgagtcagtgagcgaggacacagcggattgcattaggttttagtttcttgtataatgcttaatgttggtcactgacaggctacgatacggaaggttgctcacgcccggcccctttgccatggctagtgtgtggaaatttccgaggagcaagtctatttccaaaaatgggcgaaaaaggaggtaatacagtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 902 - DNA, 15487 bp, Artificial Sequence
  Synthetic
ccagcaacgcggcctttttacggttcctggccttttgctggccttttgctcacatgttctttcctgcgttatcccctgattctgtggataaccgtattaccgcctttgagtgagctggcggccgctgcatgcctgcaggtcgactctagaggatccccgggccaggcatcaaataaaacgaaaggctcagtcgaaagactgggcctttcgttttatctgttgtttgtcggtgaacgctctctactagagtcacactggctcaccttcgggtgggcctttctgcgtttatactcataccctttctgagccgggtaccgagctcgtggataaccgtattaccgcctttgagtgagctgataccgctcgccgcagccgaactaccgagcgcagcgagtcagtgagcgaggacacccgacctgtctcttatgacaaaaagagcaaaattttgataaaatagtattagagctgagctggtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccaggcgcgcctattctaaatgcataataaatactgataacatcttatattttgtattatattttgtattatcgttgacatgtataattttgatatcaaaaactgattttccctctattattttcgagatttattttcttaattctctttaacaaactagaaatattgtatatacaaaaaattataaataatagatgaatagtttaattataggtgttcatcaatcgaaaaagcaacgtatcttatttaaagtgcgttgcttttttctcatttataaggttaaataattctcatatatcaagcaaaggcgcctttgcggaaagagttaataagttaacagaagatgaaccaaaactaaatggtttagcaggaaacttagataaaaaaatgaatccagaattatattcagaacaggaacagcaacaagaacaacaaaagaatcaaaaacgagatagaggtatgcacttatagaacatgcatttatgccgagaaaacttattggttggaatgggctatgtgttagctaacttgttagcgagttggttggacttgaattgggattaatcccaagaaagtaccaactcaacaacacataaagccctgtaggttccgaccaataaggaaattggaataaagcaataaaaggagttgaagaaatgaaattcagagaagcctttgagaattttataacaagtaagtatgtacttggtgttttagtagttttaactgtttaccagataatacaaatgcttaaataaaaaaagacttgatctgattagaccaaatcttttgatagtgttatattaataacaaaataaaaaggagtcgctcacgacctgaccaaagtttgtgaacgacatcattcaaagaaaaaaacactgagttgtttttataatcttgtatatttagatattaaacgatatttaaatatacatcaagatatatatttgggtgagcgattccttaaacgaaattgagattaaggagtcgattttttatgtataaaaacaatcatgcaaatcattcaaatcatttggaaaatcacgatttagacaatttttctaaaaccggctactctaatagccggttggacgcacatactgtgtgcatatctgatccaaaattaagttttgatgcaatgacgatcgttggaaatctcaaccgagacaacgctcaagccctttctaaatttatgagtgtagagccccaaataagactttgggatattcttcaaacaaagtttaaagctaaagcacttcaagaaaaagtttatattgaatatgacaaagtgaaagcagatagttgggatagacgtaatatgcgtattgaatttaatccaaacaaacttacacgagatgaaatgatttggttaaaacaaaatataataagctacatggaagatgacggttttacaagattagatttagcctttgattttgaagatgatttgagtgactactatgcaatgtctgataaagcagttaagaaaactattttttatggtcgtaatggtaagccagaaacaaaatattttggcgtgagagatagtaatagatttattagaatttataataaaaagcaagaacgtaaagataatgcagatgctgaagttatgtctgaacatttatggcgtgtagaaatcgaatttaaaagagatatggtggattactggaatgattgctttagtgatttacatatcttgcaaccagattggaaaactatccaacgcactgcggatagagcaatagtttttatgttattgagtgatgaagaagaatggggaaagcttcacagaaattctagaacaaaatataagaatttgataaaagaaatttcgccagtcgatttaacggacttaatgaaatcgactttaaaagcgaacgaaaaacaattgcaaaaacaaatcgatttttggcaacatgaatttaaattttggaaatagtgtacatattaatattactgaacaaaaatgatatatttaaactattctaatttaggaggatttttttatgaagtgtctatttaaaaatttggggaatttatatgaggtgaaagaataatttacccctataaactttagtcacctcaagtaaagaggtaaaattgtttagtttatataaaaaatttaaaggtttgttttatagcgttttattttggctttgtattctttcattttttagtgtattaaatgaaatggttttaaatgtttctttacctgatattgcaaatcattttaatactactcctggaattacaaactgggtaaacactgcatatatgttaactttttcgataggaacagcagtatatggaaaattatctgattatataaatataaaaaaattgttaattattggtattagtttgagctgtcttggttcattgattgcttttattgggcccacctaggtattatcaagataagaaagaaaaggatttttcgctacgctcaaatcctttaaaaaaacacaaaagaccacattttttaatgtggtcttttattcttcaactaaagcacccattagttcaacaaacgaaaattggataaagtgggatatttttaaaatatatatttatgttacagtaatattgacttttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataatatgagataatgccgactgtactttttacagtcggttttctaatgtcactaacctgccccgttagttgaagaaggccgcggcctcgagatccaagtaaaaaacaagagagcattattagacgcattggcttatttctcgagcggccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacg

SEQ ID NO: 903 - DNA, 6659 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgacaagcttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 904 - DNA, 7781 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 905 - DNA, 6962 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 906 - DNA, 9077 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctataatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 907 - DNA, 7031 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgataataacattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 908 - DNA, 6569 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcagtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 909 - DNA, 8463 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgacaagcttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 910 - DNA, 9467 bp, Artificial Sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgacaagcttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 911 - DNA, 7 bp, Artificial Sequence
  Synthetic
  misc_feature (1)..(2): n is a, c, g, or t
nnagaaw

SEQ ID NO: 912 - DNA, 8 bp, Artificial Sequence
  Synthetic
  misc_feature (1)..(4): n is a, c, g, or t
nnnngatt

SEQ ID NO: 913 - DNA, 6 bp, Artificial Sequence
  Synthetic
  misc_feature (1)..(2): n is a, c, g, or t
nnagaa

SEQ ID NO: 914 - DNA, 6 bp, Artificial Sequence
  Synthetic
  misc_feature (1)..(1): n is a, c, g, or t
naaaac

SEQ ID NO: 915 - DNA, 74 bp, Artificial Sequence
  Synthetic
ttcatcaagccattggaccgccttacaggacgctttggcttcattgcttttcagcttcgccttgacggccaaaa

SEQ ID NO: 916 - DNA, 74 bp, Artificial Sequence
  Synthetic
ttttggccgtcaaggcgaagctgaaaagcaatgaagccaaagcgtcctgtaaggcggtccaatggcttgatgaa

SEQ ID NO: 917 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataactgctcggctggctctcggtttctctgctttccgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 918 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataactgcagcactggatgctttgtgagttggggattgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 919 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacgattggccccagccgccctggtgactcgacgcgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 920 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataactcggggaacctgttctgttaggttccgccagggtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 921 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacggccgctgggcgtagctgcgactcggcggagtgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 922 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataaccggcggcgcgtccttgttctaacccggcgcgcgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 923 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacaaagcactcatttaactggtattgcggagccagtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 924 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacgtcttgtttgtcccacccttggtgacgcagaggtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 925 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacgcgaggtattcggctccgcgacggaggctaaggtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 926 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacgctttcacggaggttcgacgcgcttccgcggcgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 927 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacatgttgcagttcggctcgatatcgtttccgctgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 928 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacttcgggggggacggggcagggcggggttcggcgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 929 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacggcggctctagagcctctgctaaccatgttcagtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 930 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataactgggcaacgtgctggttattgtggccaccatggtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 931 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacatggtgagcaagggcgaagaagataacatggcgtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 932 - DNA, 10896 bp, Artificial Sequence
  Synthetic
atcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatacgactcactatagggtctagaattcctgtgaactgccgagtaggtagctgataacgtgaacggccacgagttcgagatcgagggcgagtgaactgccgagtaggtagctgataacgttgcagcggccgctttttttcttctgaggcggaaagaaccagctggggctctagggggtatccccacgcgccctgtagcggcgaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggggcccaagaagaaaaggaaggtcggctcagccatgaagctgccaaccaacctggcctacgagcggagcatcgaccccagcgacgtgtgcttcttcgtggtgtggccagacgataggaaaacccccctgacatacaattcccgcacactgctgggacagatggaggcagccagcctggcatacgacgtgtccggccagcctatcaagtctgccaccgcagaggccctggcacagggcaaccctcaccaggtggatttctgccatgtgccatacggcgccagccacatcgagtgtagcttctccgtgtcttttagctccgagctgcggcagccatataagtgtaattctagcaaggtgaagcagacactggtgcagctggtggagctgtacgaaaccaagatcggctggacagagctggccacccggtatctgatgaatatctgcaacggcaagtggctgtggaagaatacaagaaaggcctactgttggaacatcgtgctgaccccctggccttggaatggcgagaaagtgggcttcgaggacatcaggaccaactatacatcccgccaggacttcaagaacaataagaattggtctgccatcgtggagatgatcaagacagccttctcctctaccgacggcctggccatctttgaggtgagggccacactgcacctgccaaccaacgcaatggtgcgccctagccaggtgttcacagagaaggagagcggctccaagtctaagagcaagacccagaactctagggtgttccagagcaccacaatcgatggagagcggagcccaatcctgggagcctttaagacaggcgccgccatcgccaccatcgacgattggtatccagaggcaaccgagcctctgagggtgggccgctttggagtgcacagggaggacgtgacatgctacagacacccatctaccggcaaggatttctttagcatcctccagcaggccgagcactatatcgaggtgctgagtgccaacaagacacccgcccaggaaaccatcaatgacatgcacttcctgatggccaacctgatcaagggcggcatgtttcagcacaagggcgacgggtccggagagggaaggggctctctgctgacctgcggcgacgtggaggagaaccctggacctggaccgaaaaagaagcgaaaagttggatccggcatgttcctccagaggccaaagccctacagcgacgagtccctggagtctttctttatcagagtggccaataagaacggctatggcgatgtgcacaggttcctggaggccaccaagcggttcctccaggacatcgatcacaacggctaccagacctttccaacagacatcaccaggatcaatccctatagcgccaagaacagctcctctgcccgcacagcctccttcctgaagctggcccagctgacctttaatgagccacctgagctgctgggactggccatcaatcggacaaacatgaagtactccccttctaccagcgccgtggtgagaggagcagaggtgttcccacggtccctgctgagaacccacagcatcccatgctgtcccctgtgcctgagagagaacggctacgccagctatctgtggcacttccagggctacgagtattgtcactcccacaatgtgcctctgatcaccacatgctcttgtggcaaggagtttgactacagggtgagcggcctgaagggcatctgctgtaagtgcaaggagccaatcaccctgacaagccgcgagaatggccacgaggccgcctgtaccgtgtccaactggctggccggccacgagtctaagcctctgccaaacctgcccaagtcctatagatggggactggtgcactggtggatgggcatcaaggactccgagttcgatcacttctcttttgtgcagttctttagcaactggcctcggagcttccactccatcatcgaggacgaggtggagtttaatctggagcacgccgtggtgtccacctctgagctgcggctgaaggatctgctgggcagactgttctttggcagcatcaggctgccagagcgcaatctccagcacaacatcatcctgggcgagctgctgtgctacctggagaaccgcctgtggcaggacaagggcctgatcgccaatctgaagatgaacgccctggaggccacagtgatgctgaattgttccctggatcagatcgcctctatggtggagcagcgcatcctgaagcccaatagaaagtccaagcctaactctccactggacgtgaccgattacctgttccactttggcgacatcttctgcctgtggctggccgagtttcagtccgatgagttcaaccggagcttctacgtgagccggtggggctcgagcgagggaaggggctccctgctgacttgtggcgacgtggaggagaaccctggacctagcccaaaaaagaaacgcaaggtgggcaccggtgtgaagtggtactataagaccatcacattcctgcctgagctgtgcaacaatgagtctctggcagcaaagtgtctgcgggtgctgcacggcttcaattaccagtatgagacaagaaacatcggcgtgtcctttccactgtggtgcgacgccaccgtgggcaagaagatctctttcgtgagcaagaacaagatcgagctggatctgctgctgaagcagcactacttcgtgcagatggagcagctccagtattttcacatcagcaatacagtgctggtgcccgaggactgcacctacgtgagctttcggagatgtcagtccatcgataagctgaccgcagcaggactggcaagaaagatcaggcgcctggagaagcgggccctgtccagaggcgagcagttcgacccatctagctttgcccagaaggagcacacagccatcgcccactaccactctctgggcgagtcctctaagcagaccaatcggaacttcagactgaacatcaggatgctgagtgagcagccaagggagggcaattccatcttcagctcctatggcctgagcaattccgagaactcttttcagcccgtgcctctgatcggtaaccaggagggaagaggctccctgctgacatgtggcgacgtggaagaaaaccctggacctggccctaaaaaaaagcggaaggtaggtaccggcatgcagaccctgaaggagctgatcgccagcaaccccgacgatctgaccacagagctgaagagggccttccgccccctgacacctcacatcgccatcgacggcaatgagctggatgccctgaccatcctggtgaacctgacagacaagaccgacgatcagaaggacctgctggatcgggccaagtgtaagcagaagctgagagatgagaagtggtgggcctcctgcatcaactgcgtgaactacaggcagtctcacaacccaaagttccccgacatccgcagcgagggcgtgatcagaacacaggccctgggcgagctgcccagctttctgctgtctagctccaagatcccaccctaccactggtcttatagccacgactctaagtatgtgaataagagcgccttcctgaccaacgagttttgctgggatggcgagatcagctgtctgggcgagctgctgaaggacgccgatcaccctctgtggaacacactgaagaagctgggctgctcccagaaaacctgtaaggcaatggccaagcagctggccgacatcacactgaccacaatcaatgtgaccctggcccccaactacctgacacagatctctctgcctgactccgatacatcttatatctccctgtctcctgtggccagcctgtccatgcagagccacttccaccagaggctccaggatgagaacaggcactccgccatcacccggttcagccggaccacaaatatgggagtgacagcaatgacctgcggaggagccttcaggatgctgaaaagcggcgccaagttttctagccctccacaccaccggctgaacagcaagagatcctggctgacctccgagcatgtgcagtctctgaagcagtaccagcggctgaataagagcctgatcccagagaactccagaatcgccctgcggagaaagtataagatcgagctgcaaaatatggtgcgctcttggttcgccatgcaggaccacacactggatagcaatatcctgatccagcacctgaaccacgacctgtcctacctgggcgccaccaagcggttcgcctatgatcccgccatgacaaagctgtttaccgagctgctgaagagagagctgtctaacagcatcaacaatggcgagcagcacaccaatggcagctttctggtgctgcctaacatcagagtgtgcggagcaaccgccctgtcctctcctgtgacagtgggcatcccatccctgaccgccttctttggcttcgtgcacgcctttgagaggaatatcaaccgcaccacaagctccttcagggtggagagctttgccatctgcgtgcaccagctgcatgtggagaagcgcggcctgacagccgagttcgtggagaagggcgacggaacaatctccgccccagcaaccagggacgattggcagtgtgatgtggtgttctctctgatcctgaataccaactttgcccagcacatcgaccaggatacactcgtcacctctctgccaaagaggctggcaaggggaagcgccaagatcgccatcgacgatttcaagcacatcaactccttttctacactggaaaccgcaatcgagagcctgccaatcgaggcaggcagatggctgagtctgtacgcccagtccaacaataacctgtctgacctgctggccgccatgacagaggatcaccagctgatggccagctgcgtgggctaccacctgctggaggagcctaaagacaagccaaactccctcagaggctataagcacgccatcgccgagtgtatcatcggcctgatcaattccatcaccttctctagcgagacagatcccaacaccatcttttggagcctgaagaattaccagaactatctggtggtgcagcctcgctccatcaatgacgaaaccaccgataagtcctctctgtgatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaagg

SEQ ID NO: 933 - protein, 832 aa, Artificial Sequence
  Synthetic
MATSLPTPSAITTSALEYAFHTPARNLTKSRGKNIHRYVSVKMSKRITVESTLECDACYHFDFEPSIVRFCAQPIRFLYYLNGQSHSYVPDFLVQFDTNEFVLYEVKSAYAKNKPDFDVEWEAKVKAATELGLELELVEESDIRDTVVLNNLKRMHRYASKDELNNVHNSLLKIIKYNGAQSARCLGEQLGLKGRTVLPILCDLLSRCLLDTRLDKPLSLESRFELASYGAKKGFSSFHRKAVSSQDTLESIELVSSANCLESVTYQDISAFPETIAVEINFRLSILRFLARKCETIVAKSIEPHRVELQQNYSRKIPSAITIYRWWLAFRKSDYNPISLAPNIKDRGNRETKVSTVVDSIMEQAVERVISGRKVNVSSAYKRVRRKVRQYNLTHGTKYTYPKYESVRKRVKKKTPFELLAAGKGERVAKREFRRMGKKILTSSVLERVEIDHTVVDLFAVHEEYRIPLGRPWLTQLVDCYSKAVIGFYLGFEPPSYVSVSLALKNAIQRKDDLISSYESIENEWLCYGIPDLLVTDNGKEFLSKAFDQACESLLINVHQNKVETPDNKPHVERNYGTINTSLLDDLPGKSFSQYLQREGYDSVGEATLTLNEIREIYLIWLVDIYHKKPNQRGTNCPNVAWKKGCQEWEPEEFSGSKDELDFKFAIVDYKQLTKVGITVYKELSYSNDRLAEYRGKKGNHKVQFKYNPECMAVIWVLDEDMNEYFTVNAIDYEYASRVSLWQHKYNMKYQAELNSAEYDEDKEIDAEIKIEEIADRSIVKTNKIRARRRGARHQENSARAKSISNANPASIQKHEDEIVSADNDDWDIDYV

SEQ ID NO: 934 - DNA, 6860 bp, Artificial Sequence
  Synthetic
ttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggcgctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagat

SEQ ID NO: 935 - DNA, 20 bp, Artificial Sequence
  Synthetic
caaccataaaatgataatta

SEQ ID NO: 936 - DNA, 20 bp, Artificial Sequence
  Synthetic
cacccataaattgataatta

SEQ ID NO: 937 - DNA, 20 bp, Artificial Sequence
  Synthetic
cacccataaattgatattgc

SEQ ID NO: 938 - DNA, 25 bp, Artificial Sequence
  Synthetic
gtctaaacttcagtaagtttacgac

SEQ ID NO: 939 - DNA, 20 bp, Artificial Sequence
  Synthetic
caaccataagttgatatttt

SEQ ID NO: 940 - DNA, 20 bp, Artificial Sequence
  Synthetic
caaccatatattgatatctc

SEQ ID NO: 941 - DNA, 20 bp, Artificial Sequence
  Synthetic
caaccataaagtgatattta

SEQ ID NO: 942 - DNA, 18 bp, Artificial Sequence
  Synthetic
cctgatatgtcatgggat

SEQ ID NO: 943 - DNA, 18 bp, Artificial Sequence
  Synthetic
cacatgattacgccaagc

SEQ ID NO: 944 - DNA, 18 bp, Artificial Sequence
  Synthetic
ctcactcagatggaggat

SEQ ID NO: 945 - DNA, 18 bp, Artificial Sequence
  Synthetic
gttctgctgtagtcaagc

SEQ ID NO: 946 - DNA, 18 bp, Artificial Sequence
  Synthetic
cgatacgtgacacaggat

SEQ ID NO: 947 - DNA, 18 bp, Artificial Sequence
  Synthetic
gctaccgtgatacaaagc

SEQ ID NO: 948 - DNA, 18 bp, Artificial Sequence
  Synthetic
ccacagacttgagaggat

SEQ ID NO: 949 - DNA, 18 bp, Artificial Sequence
  Synthetic
cagttcttggtcgaaagc

SEQ ID NO: 950 - DNA, 27 bp, Artificial Sequence
  Synthetic
catggatccctaccatccatgatcacg

SEQ ID NO: 951 - DNA, 31 bp, Artificial Sequence
  Synthetic
gccaagcttctgttgatacaaccataaaatg

SEQ ID NO: 952 - DNA, 18 bp, Artificial Sequence
  Synthetic
ggaaaggtactcgaagct

SEQ ID NO: 953 - DNA, 18 bp, Artificial Sequence
  Synthetic
ctactcagtgtcaaaccc

SEQ ID NO: 954 - DNA, 130 bp, Artificial Sequence
  Synthetic
cacatgattacgccaagctttgttgatacaaccataaaatgataattacacccataaattgataattatcacacccataaattgatattgcctcttcatggtctaaacttggatcccatgacatatcagg

SEQ ID NO: 955 - DNA, 130 bp, Artificial Sequence
  Synthetic
cacatgattacgccaagctttgttgatacacccataaattgataattacacccataaattgataattatcacacccataaattgatattgcctcttcatggtctaaacttggatcccatgacatatcagg

SEQ ID NO: 956 - DNA, 130 bp, Artificial Sequence
  Synthetic
cacatgattacgccaagctttgttgatacacccataaattgatattgccacccataaattgataattatcacacccataaattgatattgcctcttcatggtctaaacttggatcccatgacatatcagg

SEQ ID NO: 957 - DNA, 130 bp, Artificial Sequence
  Synthetic
cacatgattacgccaagctttgttgatagtctaaacttcagtaagtttacgaccacccataaattgataattatcacacccataaattgatattgcctcttcatggtctaggatcccatgacatatcagg

SEQ ID NO: 958 - DNA, 130 bp, Artificial Sequence
  Synthetic
cacatgattacgccaagctttgttgatacaaccataagttgatattttcacccataaattgataattatcacacccataaattgatattgcctcttcatggtctaaacttggatcccatgacatatcagg

SEQ ID NO: 959 - DNA, 130 bp, Artificial Sequence
  Synthetic
cacatgattacgccaagctttgttgatacaaccatatattgatatctccacccataaattgataattatcacacccataaattgatattgcctcttcatggtctaaacttggatcccatgacatatcagg

SEQ ID NO: 960 - DNA, 130 bp, Artificial Sequence
  Synthetic
cacatgattacgccaagctttgttgatacaaccataaagtgatatttacacccataaattgataattatcacacccataaattgatattgcctcttcatggtctaaacttggatcccatgacatatcagg

SEQ ID NO: 961 - DNA, 130 bp, Artificial Sequence
  Synthetic
cacatgattacgccaagctttgttgatacaaccataaaatgataattacacccataaattgatattgctcacacccataaattgatattgcctcttcatggtctaaacttggatcccatgacatatcagg

SEQ ID NO: 962 - DNA, 130 bp, Artificial Sequence
  Synthetic
cacatgattacgccaagctttgttgatacacccataaattgataattacacccataaattgatattgctcacacccataaattgatattgcctcttcatggtctaaacttggatcccatgacatatcagg

SEQ ID NO: 963 - DNA, 130 bp, Artificial Sequence
  Synthetic
cacatgattacgccaagctttgttgatacacccataaattgatattgccacccataaattgatattgctcacacccataaattgatattgcctcttcatggtctaaacttggatcccatgacatatcagg

SEQ ID NO: 964 - DNA, 130 bp, Artificial Sequence
  Synthetic
cacatgattacgccaagctttgttgatagtctaaacttcagtaagtttacgaccacccataaattgatattgctcacacccataaattgatattgcctcttcatggtctaggatcccatgacatatcagg

SEQ ID NO: 965 - DNA, 130 bp, Artificial Sequence
  Synthetic
cacatgattacgccaagctttgttgatacaaccataagttgatattttcacccataaattgatattgctcacacccataaattgatattgcctcttcatggtctaaacttggatcccatgacatatcagg

SEQ ID NO: 966 - DNA, 130 bp, Artificial Sequence
  Synthetic
cacatgattacgccaagctttgttgatacaaccatatattgatatctccacccataaattgatattgctcacacccataaattgatattgcctcttcatggtctaaacttggatcccatgacatatcagg

SEQ ID NO: 967 - DNA, 130 bp, Artificial Sequence
  Synthetic
cacatgattacgccaagctttgttgatacaaccataaagtgatatttacacccataaattgatattgctcacacccataaattgatattgcctcttcatggtctaaacttggatcccatgacatatcagg

SEQ ID NO: 968 - DNA, 130 bp, Artificial Sequence
  Synthetic
cacatgattacgccaagctttgttgatacaaccataaaatgataattagtctaaacttcagtaagtttacgactcacacccataaattgatattgcctcttcatggtctaggatcccatgacatatcagg

SEQ ID NO: 969 - DNA, 130 bp, Artificial Sequence
  Synthetic
cacatgattacgccaagctttgttgatacacccataaattgataattagtctaaacttcagtaagtttacgactcacacccataaattgatattgcctcttcatggtctaggatcccatgacatatcagg

SEQ ID NO: 970 - DNA, 130 bp, Artificial Sequence
  Synthetic
cacatgattacgccaagctttgttgatacacccataaattgatattgcgtctaaacttcagtaagtttacgactcacacccataaattgatattgcctcttcatggtctaggatcccatgacatatcagg

SEQ ID NO: 971 - DNA, 130 bp, Artificial Sequence
  Synthetic
cacatgattacgccaagctttgttgatagtctaaacttcagtaagtttacgacgtctaaacttcagtaagtttacgactcacacccataaattgatattgcctcttcatgggatcccatgacatatcagg

SEQ ID NO: 972 - DNA, 130 bp, Artificial Sequence
  Synthetic
cacatgattacgccaagctttgttgatacaaccataagttgatattttgtctaaacttcagtaagtttacgactcacacccataaattgatattgcctcttcatggtctaggatcccatgacatatcagg

SEQ ID NO: 973 - DNA, 130 bp, Artificial Sequence
  Synthetic
cacatgattacgccaagctttgttgatacaaccatatattgatatctcgtctaaacttcagtaagtttacgactcacacccataaattgatattgcctcttcatggtctaggatcccatgacatatcagg

SEQ ID NO: 974 - DNA, 130 bp, Artificial Sequence
  Synthetic
cacatgattacgccaagctttgttgatacaaccataaagtgatatttagtctaaacttcagtaagtttacgactcacacccataaattgatattgcctcttcatggtctaggatcccatgacatatcagg

SEQ ID NO: 975 - DNA, 130 bp, Artificial Sequence
  Synthetic
cacatgattacgccaagctttgttgatacaaccataaaatgataattacaaccataagttgatatttttcacacccataaattgatattgcctcttcatggtctaaacttggatcccatgacatatcagg

SEQ ID NO: 976 - DNA, 130 bp, Artificial Sequence
  Synthetic
cacatgattacgccaagctttgttgatacacccataaattgataattacaaccataagttgatatttttcacacccataaattgatattgcctcttcatggtctaaacttggatcccatgacatatcagg

SEQ ID NO: 977 - DNA, 130 bp, Artificial Sequence
  Synthetic
cacatgattacgccaagctttgttgatacacccataaattgatattgccaaccataagttgatatttttcacacccataaattgatattgcctcttcatggtctaaacttggatcccatgacatatcagg

SEQ ID NO: 978 - DNA, 130 bp, Artificial Sequence
  Synthetic
cacatgattacgccaagctttgttgatagtctaaacttcagtaagtttacgaccaaccataagttgatatttttcacacccataaattgatattgcctcttcatggtctaggatcccatgacatatcagg

SEQ ID NO: 979 - DNA, 130 bp, Artificial Sequence
  Synthetic
cacatgattacgccaagctttgttgatacaaccataagttgatattttcaaccataagttgatatttttcacacccataaattgatattgcctcttcatggtctaaacttggatcccatgacatatcagg

SEQ ID NO: 980 - DNA, 130 bp, Artificial Sequence
  Synthetic
cacatgattacgccaagctttgttgatacaaccatatattgatatctccaaccataagttgatatttttcacacccataaattgatattgcctcttcatggtctaaacttggatcccatgacatatcagg

SEQ ID NO: 981 - DNA, 130 bp, Artificial Sequence
  Synthetic
cacatgattacgccaagctttgttgatacaaccataaagtgatatttacaaccataagttgatatttttcacacccataaattgatattgcctcttcatggtctaaacttggatcccatgacatatcagg

SEQ ID NO: 982 - DNA, 130 bp, Artificial Sequence
  Synthetic
cacatgattacgccaagctttgttgatacaaccataaaatgataattacaaccatatattgatatctctcacacccataaattgatattgcctcttcatggtctaaacttggatcccatgacatatcagg

SEQ ID NO: 983 - DNA, 130 bp, Artificial Sequence
  Synthetic
cacatgattacgccaagctttgttgatacacccataaattgataattacaaccatatattgatatctctcacacccataaattgatattgcctcttcatggtctaaacttggatcccatgacatatcagg

SEQ ID NO: 984 - DNA, 130 bp, Artificial Sequence
  Synthetic
cacatgattacgccaagctttgttgatacacccataaattgatattgccaaccatatattgatatctctcacacccataaattgatattgcctcttcatggtctaaacttggatcccatgacatatcagg

SEQ ID NO: 985 - DNA, 130 bp, Artificial Sequence
  Synthetic
cacatgattacgccaagctttgttgatagtctaaacttcagtaagtttacgaccaaccatatattgatatctctcacacccataaattgatattgcctcttcatggtctaggatcccatgacatatcagg

SEQ ID NO: 986 - DNA, 130 bp, Artificial Sequence
  Synthetic
cacatgattacgccaagctttgttgatacaaccataagttgatattttcaaccatatattgatatctctcacacccataaattgatattgcctcttcatggtctaaacttggatcccatgacatatcagg

SEQ ID NO: 987 - DNA, 130 bp, Artificial Sequence
  Synthetic
cacatgattacgccaagctttgttgatacaaccatatattgatatctccaaccatatattgatatctctcacacccataaattgatattgcctcttcatggtctaaacttggatcccatgacatatcagg

SEQ ID NO: 988 - DNA, 130 bp, Artificial Sequence
  Synthetic
cacatgattacgccaagctttgttgatacaaccataaagtgatatttacaaccatatattgatatctctcacacccataaattgatattgcctcttcatggtctaaacttggatcccatgacatatcagg

SEQ ID NO: 989 - DNA, 130 bp, Artificial Sequence
  Synthetic
cacatgattacgccaagctttgttgatacaaccataaaatgataattacaaccataaagtgatatttatcacacccataaattgatattgcctcttcatggtctaaacttggatcccatgacatatcagg

SEQ ID NO: 990 - DNA, 130 bp, Artificial Sequence
  Synthetic
cacatgattacgccaagctttgttgatacacccataaattgataattacaaccataaagtgatatttatcacacccataaattgatattgcctcttcatggtctaaacttggatcccatgacatatcagg

SEQ ID NO: 991 - DNA, 130 bp, Artificial Sequence
  Synthetic
cacatgattacgccaagctttgttgatacacccataaattgatattgccaaccataaagtgatatttatcacacccataaattgatattgcctcttcatggtctaaacttggatcccatgacatatcagg

SEQ ID NO: 992 - DNA, 130 bp, Artificial Sequence
  Synthetic
cacatgattacgccaagctttgttgatagtctaaacttcagtaagtttacgaccaaccataaagtgatatttatcacacccataaattgatattgcctcttcatggtctaggatcccatgacatatcagg

SEQ ID NO: 993 - DNA, 130 bp, Artificial Sequence
  Synthetic
cacatgattacgccaagctttgttgatacaaccataagttgatattttcaaccataaagtgatatttatcacacccataaattgatattgcctcttcatggtctaaacttggatcccatgacatatcagg

SEQ ID NO: 994 - DNA, 130 bp, Artificial Sequence
  Synthetic
cacatgattacgccaagctttgttgatacaaccatatattgatatctccaaccataaagtgatatttatcacacccataaattgatattgcctcttcatggtctaaacttggatcccatgacatatcagg

SEQ ID NO: 995 - DNA, 130 bp, Artificial Sequence
  Synthetic
cacatgattacgccaagctttgttgatacaaccataaagtgatatttacaaccataaagtgatatttatcacacccataaattgatattgcctcttcatggtctaaacttggatcccatgacatatcagg

SEQ ID NO: 996 - DNA, 130 bp, Artificial Sequence
  Synthetic
cacatgattacgccaagctttgttgatacaaccataaaatgataattacaaccataaaatgataattatcacacccataaattgatattgcctcttcatggtctaaacttggatcccatgacatatcagg

SEQ ID NO: 997 - DNA, 130 bp, Artificial Sequence
  Synthetic
cacatgattacgccaagctttgttgatacacccataaattgataattacaaccataaaatgataattatcacacccataaattgatattgcctcttcatggtctaaacttggatcccatgacatatcagg

SEQ ID NO: 998 - DNA, 130 bp, Artificial Sequence
  Synthetic
cacatgattacgccaagctttgttgatacacccataaattgatattgccaaccataaaatgataattatcacacccataaattgatattgcctcttcatggtctaaacttggatcccatgacatatcagg

SEQ ID NO: 999 - DNA, 130 bp, Artificial Sequence
  Synthetic
cacatgattacgccaagctttgttgatagtctaaacttcagtaagtttacgaccaaccataaaatgataattatcacacccataaattgatattgcctcttcatggtctaggatcccatgacatatcagg

SEQ ID NO: 1000 - DNA, 130 bp, Artificial Sequence
  Synthetic
cacatgattacgccaagctttgttgatacaaccataagttgatattttcaaccataaaatgataattatcacacccataaattgatattgcctcttcatggtctaaacttggatcccatgacatatcagg

SEQ ID NO: 1001 - DNA, 130 bp, Artificial Sequence
  Synthetic
cacatgattacgccaagctttgttgatacaaccatatattgatatctccaaccataaaatgataattatcacacccataaattgatattgcctcttcatggtctaaacttggatcccatgacatatcagg

SEQ ID NO: 1002 - DNA, 130 bp, Artificial Sequence
  Synthetic
cacatgattacgccaagctttgttgatacaaccataaagtgatatttacaaccataaaatgataattatcacacccataaattgatattgcctcttcatggtctaaacttggatcccatgacatatcagg

SEQ ID NO: 1003 - DNA, 130 bp, Artificial Sequence
  Synthetic
cacatgattacgccaagctttgttgatacaaccataaaatgataattacacccataaattgataattatcagtctaaacttcagtaagtttacgacctcttcatggtctaggatcccatgacatatcagg

SEQ ID NO: 1004 - DNA, 130 bp, Artificial Sequence
  Synthetic
cacatgattacgccaagctttgttgatacacccataaattgataattacacccataaattgataattatcagtctaaacttcagtaagtttacgacctcttcatggtctaggatcccatgacatatcagg

SEQ ID NO: 1005 - DNA, 130 bp, Artificial Sequence
  Synthetic
cacatgattacgccaagctttgttgatacacccataaattgatattgccacccataaattgataattatcagtctaaacttcagtaagtttacgacctcttcatggtctaggatcccatgacatatcagg

SEQ ID NO: 1006 - DNA, 130 bp, Artificial Sequence
  Synthetic
cacatgattacgccaagctttgttgatagtctaaacttcagtaagtttacgaccacccataaattgataattatcagtctaaacttcagtaagtttacgacctcttcatgggatcccatgacatatcagg

SEQ ID NO: 1007 - DNA, 130 bp, Artificial Sequence
  Synthetic
cacatgattacgccaagctttgttgatacaaccataagttgatattttcacccataaattgataattatcagtctaaacttcagtaagtttacgacctcttcatggtctaggatcccatgacatatcagg

SEQ ID NO: 1008 - DNA, 130 bp, Artificial Sequence
  Synthetic
cacatgattacgccaagctttgttgatacaaccatatattgatatctccacccataaattgataattatcagtctaaacttcagtaagtttacgacctcttcatggtctaggatcccatgacatatcagg

SEQ ID NO: 1009 - DNA, 130 bp, Artificial Sequence
  Synthetic
cacatgattacgccaagctttgttgatacaaccataaagtgatatttacacccataaattgataattatcagtctaaacttcagtaagtttacgacctcttcatggtctaggatcccatgacatatcagg

SEQ ID NO: 1010 - DNA, 130 bp, Artificial Sequence
  Synthetic
cacatgattacgccaagctttgttgatacaaccataaaatgataattacacccataaattgatattgctcagtctaaacttcagtaagtttacgacctcttcatggtctaggatcccatgacatatcagg

SEQ ID NO: 1011 - DNA, 130 bp, Artificial Sequence
  Synthetic
cacatgattacgccaagctttgttgatacacccataaattgataattacacccataaattgatattgctcagtctaaacttcagtaagtttacgacctcttcatggtctaggatcccatgacatatcagg

SEQ ID NO: 1012 - DNA, 130 bp, Artificial Sequence
  Synthetic
cacatgattacgccaagctttgttgatacacccataaattgatattgccacccataaattgatattgctcagtctaaacttcagtaagtttacgacctcttcatggtctaggatcccatgacatatcagg

SEQ ID NO: 1013 - DNA, 130 bp, Artificial Sequence
  Synthetic
cacatgattacgccaagctttgttgatagtctaaacttcagtaagtttacgaccacccataaattgatattgctcagtctaaacttcagtaagtttacgacctcttcatgggatcccatgacatatcagg

SEQ ID NO: 1014 - DNA, 130 bp, Artificial Sequence
  Synthetic
cacatgattacgccaagctttgttgatacaaccataagttgatattttcacccataaattgatattgctcagtctaaacttcagtaagtttacgacctcttcatggtctaggatcccatgacatatcagg

SEQ ID NO: 1015 - DNA, 130 bp, Artificial Sequence
  Synthetic
cacatgattacgccaagctttgttgatacaaccatatattgatatctccacccataaattgatattgctcagtctaaacttcagtaagtttacgacctcttcatggtctaggatcccatgacatatcagg

SEQ ID NO: 1016 - DNA, 130 bp, Artificial Sequence
  Synthetic
cacatgattacgccaagctttgttgatacaaccataaagtgatatttacacccataaattgatattgctcagtctaaacttcagtaagtttacgacctcttcatggtctaggatcccatgacatatcagg

SEQ ID NO: 1017 - DNA, 130 bp, Artificial Sequence
  Synthetic
cacatgattacgccaagctttgttgatacaaccataaaatgataattagtctaaacttcagtaagtttacgactcagtctaaacttcagtaagtttacgacctcttcatgggatcccatgacatatcagg

SEQ ID NO: 1018 - DNA, 130 bp, Artificial Sequence
  Synthetic
cacatgattacgccaagctttgttgatacacccataaattgataattagtctaaacttcagtaagtttacgactcagtctaaacttcagtaagtttacgacctcttcatgggatcccatgacatatcagg

SEQ ID NO: 1019 - DNA, 130 bp, Artificial Sequence
  Synthetic
cacatgattacgccaagctttgttgatacacccataaattgatattgcgtctaaacttcagtaagtttacgactcagtctaaacttcagtaagtttacgacctcttcatgggatcccatgacatatcagg

SEQ ID NO: 1020 - DNA, 130 bp, Artificial Sequence
  Synthetic
cacatgattacgccaagctttgttgatagtctaaacttcagtaagtttacgacgtctaaacttcagtaagtttacgactcagtctaaacttcagtaagtttacgacctctggatcccatgacatatcagg

SEQ ID NO: 1021 - DNA, 130 bp, Artificial Sequence
  Synthetic
cacatgattacgccaagctttgttgatacaaccataagttgatattttgtctaaacttcagtaagtttacgactcagtctaaacttcagtaagtttacgacctcttcatgggatcccatgacatatcagg

SEQ ID NO: 1022 - DNA, 130 bp, Artificial Sequence
  Synthetic
cacatgattacgccaagctttgttgatacaaccatatattgatatctcgtctaaacttcagtaagtttacgactcagtctaaacttcagtaagtttacgacctcttcatgggatcccatgacatatcagg

SEQ ID NO: 1023 - DNA, 130 bp, Artificial Sequence
  Synthetic
cacatgattacgccaagctttgttgatacaaccataaagtgatatttagtctaaacttcagtaagtttacgactcagtctaaacttcagtaagtttacgacctcttcatgggatcccatgacatatcagg

SEQ ID NO: 1024 - DNA, 130 bp, Artificial Sequence
  Synthetic
cacatgattacgccaagctttgttgatacaaccataaaatgataattacaaccataagttgatatttttcagtctaaacttcagtaagtttacgacctcttcatggtctaggatcccatgacatatcagg

SEQ ID NO: 1025 - DNA, 130 bp, Artificial Sequence
  Synthetic
cacatgattacgccaagctttgttgatacacccataaattgataattacaaccataagttgatatttttcagtctaaacttcagtaagtttacgacctcttcatggtctaggatcccatgacatatcagg

SEQ ID NO: 1026 - DNA, 130 bp, Artificial Sequence
  Synthetic
cacatgattacgccaagctttgttgatacacccataaattgatattgccaaccataagttgatatttttcagtctaaacttcagtaagtttacgacctcttcatggtctaggatcccatgacatatcagg

SEQ ID NO: 1027 - DNA, 130 bp, Artificial Sequence
  Synthetic
cacatgattacgccaagctttgttgatagtctaaacttcagtaagtttacgaccaaccataagttgatatttttcagtctaaacttcagtaagtttacgacctcttcatgggatcccatgacatatcagg

SEQ ID NO: 1028 - DNA, 130 bp, Artificial Sequence
  Synthetic
cacatgattacgccaagctttgttgatacaaccataagttgatattttcaaccataagttgatatttttcagtctaaacttcagtaagtttacgacctcttcatggtctaggatcccatgacatatcagg

SEQ ID NO: 1029 - DNA, 130 bp, Artificial Sequence
  Synthetic
cacatgattacgccaagctttgttgatacaaccatatattgatatctccaaccataagttgatatttttcagtctaaacttcagtaagtttacgacctcttcatggtctaggatcccatgacatatcagg

SEQ ID NO: 1030 - DNA, 130 bp, Artificial Sequence
  Synthetic
cacatgattacgccaagctttgttgatacaaccataaagtgatatttacaaccataagttgatatttttcagtctaaacttcagtaagtttacgacctcttcatggtctaggatcccatgacatatcagg

SEQ ID NO: 1031 - DNA, 130 bp, Artificial Sequence
  Synthetic
cacatgattacgccaagctttgttgatacaaccataaaatgataattacaaccatatattgatatctctcagtctaaacttcagtaagtttacgacctcttcatggtctaggatcccatgacatatcagg

SEQ ID NO: 1032 - DNA, 130 bp, Artificial Sequence
  Synthetic
cacatgattacgccaagctttgttgatacacccataaattgataattacaaccatatattgatatctctcagtctaaacttcagtaagtttacgacctcttcatggtctaggatcccatgacatatcagg

SEQ ID NO: 1033 - DNA, 130 bp, Artificial Sequence
  Synthetic
cacatgattacgccaagctttgttgatacacccataaattgatattgccaaccatatattgatatctctcagtctaaacttcagtaagtttacgacctcttcatggtctaggatcccatgacatatcagg

SEQ ID NO: 1034 - DNA, 130 bp, Artificial Sequence
  Synthetic
cacatgattacgccaagctttgttgatagtctaaacttcagtaagtttacgaccaaccatatattgatatctctcagtctaaacttcagtaagtttacgacctcttcatgggatcccatgacatatcagg

SEQ ID NO: 1035 - DNA, 130 bp, Artificial Sequence
  Synthetic
cacatgattacgccaagctttgttgatacaaccataagttgatattttcaaccatatattgatatctctcagtctaaacttcagtaagtttacgacctcttcatggtctaggatcccatgacatatcagg

SEQ ID NO: 1036 - DNA, 130 bp, Artificial Sequence
  Synthetic
cacatgattacgccaagctttgttgatacaaccatatattgatatctccaaccatatattgatatctctcagtctaaacttcagtaagtttacgacctcttcatggtctaggatcccatgacatatcagg

SEQ ID NO: 1037 - DNA, 130 bp, Artificial Sequence
  Synthetic
cacatgattacgccaagctttgttgatacaaccataaagtgatatttacaaccatatattgatatctctcagtctaaacttcagtaagtttacgacctcttcatggtctaggatcccatgacatatcagg

SEQ ID NO: 1038 - DNA, 130 bp, Artificial Sequence
  Synthetic
cacatgattacgccaagctttgttgatacaaccataaaatgataattacaaccataaagtgatatttatcagtctaaacttcagtaagtttacgacctcttcatggtctaggatcccatgacatatcagg

SEQ ID NO: 1039 - DNA, 130 bp, Artificial Sequence
  Synthetic
cacatgattacgccaagctttgttgatacacccataaattgataattacaaccataaagtgatatttatcagtctaaacttcagtaagtttacgacctcttcatggtctaggatcccatgacatatcagg

SEQ ID NO: 1040 - DNA, 130 bp, Artificial Sequence
  Synthetic
cacatgattacgccaagctttgttgatacacccataaattgatattgccaaccataaagtgatatttatcagtctaaacttcagtaagtttacgacctcttcatggtctaggatcccatgacatatcagg

SEQ ID NO: 1041 - DNA, 130 bp, Artificial Sequence
  Synthetic
cacatgattacgccaagctttgttgatagtctaaacttcagtaagtttacgaccaaccataaagtgatatttatcagtctaaacttcagtaagtttacgacctcttcatgggatcccatgacatatcagg

SEQ ID NO: 1042 - DNA, 130 bp, Artificial Sequence
  Synthetic
cacatgattacgccaagctttgttgatacaaccataagttgatattttcaaccataaagtgatatttatcagtctaaacttcagtaagtttacgacctcttcatggtctaggatcccatgacatatcagg

SEQ ID NO: 1043 - DNA, 130 bp, Artificial Sequence
  Synthetic
cacatgattacgccaagctttgttgatacaaccatatattgatatctccaaccataaagtgatatttatcagtctaaacttcagtaagtttacgacctcttcatggtctaggatcccatgacatatcagg

SEQ ID NO: 1044 - DNA, 130 bp, Artificial Sequence
  Synthetic
cacatgattacgccaagctttgttgatacaaccataaagtgatatttacaaccataaagtgatatttatcagtctaaacttcagtaagtttacgacctcttcatggtctaggatcccatgacatatcagg

SEQ ID NO: 1045 - DNA, 130 bp, Artificial Sequence
  Synthetic
cacatgattacgccaagctttgttgatacaaccataaaatgataattacaaccataaaatgataattatcagtctaaacttcagtaagtttacgacctcttcatggtctaggatcccatgacatatcagg

SEQ ID NO: 1046 - DNA, 130 bp, Artificial Sequence
  Synthetic
cacatgattacgccaagctttgttgatacacccataaattgataattacaaccataaaatgataattatcagtctaaacttcagtaagtttacgacctcttcatggtctaggatcccatgacatatcagg

SEQ ID NO: 1047 - DNA, 130 bp, Artificial Sequence
  Synthetic
cacatgattacgccaagctttgttgatacacccataaattgatattgccaaccataaaatgataattatcagtctaaacttcagtaagtttacgacctcttcatggtctaggatcccatgacatatcagg

SEQ ID NO: 1048 - DNA, 130 bp, Artificial Sequence
  Synthetic
cacatgattacgccaagctttgttgatagtctaaacttcagtaagtttacgaccaaccataaaatgataattatcagtctaaacttcagtaagtttacgacctcttcatgggatcccatgacatatcagg

SEQ ID NO: 1049 - DNA, 130 bp, Artificial Sequence
  Synthetic
cacatgattacgccaagctttgttgatacaaccataagttgatattttcaaccataaaatgataattatcagtctaaacttcagtaagtttacgacctcttcatggtctaggatcccatgacatatcagg

SEQ ID NO: 1050 - DNA, 130 bp, Artificial Sequence
  Synthetic
cacatgattacgccaagctttgttgatacaaccatatattgatatctccaaccataaaatgataattatcagtctaaacttcagtaagtttacgacctcttcatggtctaggatcccatgacatatcagg

SEQ ID NO: 1051 - DNA, 130 bp, Artificial Sequence
  Synthetic
cacatgattacgccaagctttgttgatacaaccataaagtgatatttacaaccataaaatgataattatcagtctaaacttcagtaagtttacgacctcttcatggtctaggatcccatgacatatcagg

SEQ ID NO: 1052 - DNA, 130 bp, Artificial Sequence
  Synthetic
cacatgattacgccaagctttgttgatacaaccataaaatgataattacacccataaattgataattatcacaaccataagttgatattttctcttcatggtctaaacttggatcccatgacatatcagg

SEQ ID NO: 1053 - DNA, 130 bp, Artificial Sequence
  Synthetic
cacatgattacgccaagctttgttgatacacccataaattgataattacacccataaattgataattatcacaaccataagttgatattttctcttcatggtctaaacttggatcccatgacatatcagg

SEQ ID NO: 1054 - DNA, 130 bp, Artificial Sequence
  Synthetic
cacatgattacgccaagctttgttgatacacccataaattgatattgccacccataaattgataattatcacaaccataagttgatattttctcttcatggtctaaacttggatcccatgacatatcagg

SEQ ID NO: 1055 - DNA, 130 bp, Artificial Sequence
  Synthetic
cacatgattacgccaagctttgttgatagtctaaacttcagtaagtttacgaccacccataaattgataattatcacaaccataagttgatattttctcttcatggtctaggatcccatgacatatcagg

SEQ ID NO: 1056 - DNA, 130 bp, Artificial Sequence
  Synthetic
cacatgattacgccaagctttgttgatacaaccataagttgatattttcacccataaattgataattatcacaaccataagttgatattttctcttcatggtctaaacttggatcccatgacatatcagg

SEQ ID NO: 1057 - DNA, 130 bp, Artificial Sequence
  Synthetic
cacatgattacgccaagctttgttgatacaaccatatattgatatctccacccataaattgataattatcacaaccataagttgatattttctcttcatggtctaaacttggatcccatgacatatcagg

SEQ ID NO: 1058 - DNA, 130 bp, Artificial Sequence
  Synthetic
cacatgattacgccaagctttgttgatacaaccataaagtgatatttacacccataaattgataattatcacaaccataagttgatattttctcttcatggtctaaacttggatcccatgacatatcagg

SEQ ID NO: 1059 - DNA, 130 bp, Artificial Sequence
  Synthetic
cacatgattacgccaagctttgttgatacaaccataaaatgataattacacccataaattgatattgctcacaaccataagttgatattttctcttcatggtctaaacttggatcccatgacatatcagg

SEQ ID NO: 1060 - DNA, 130 bp, Artificial Sequence
  Synthetic
cacatgattacgccaagctttgttgatacacccataaattgataattacacccataaattgatattgctcacaaccataagttgatattttctcttcatggtctaaacttggatcccatgacatatcagg

SEQ ID NO: 1061 - DNA, 130 bp, Artificial Sequence
  Synthetic
cacatgattacgccaagctttgttgatacacccataaattgatattgccacccataaattgatattgctcacaaccataagttgatattttctcttcatggtctaaacttggatcccatgacatatcagg

SEQ ID NO: 1062 - DNA, 130 bp, Artificial Sequence
  Synthetic
cacatgattacgccaagctttgttgatagtctaaacttcagtaagtttacgaccacccataaattgatattgctcacaaccataagttgatattttctcttcatggtctaggatcccatgacatatcagg

SEQ ID NO: 1063 - DNA, 130 bp, Artificial Sequence
  Synthetic
cacatgattacgccaagctttgttgatacaaccataagttgatattttcacccataaattgatattgctcacaaccataagttgatattttctcttcatggtctaaacttggatcccatgacatatcagg

SEQ ID NO: 1064 - DNA, 130 bp, Artificial Sequence
  Synthetic
cacatgattacgccaagctttgttgatacaaccatatattgatatctccacccataaattgatattgctcacaaccataagttgatattttctcttcatggtctaaacttggatcccatgacatatcagg

SEQ ID NO: 1065 - DNA, 130 bp, Artificial Sequence
  Synthetic
cacatgattacgccaagctttgttgatacaaccataaagtgatatttacacccataaattgatattgctcacaaccataagttgatattttctcttcatggtctaaacttggatcccatgacatatcagg

SEQ ID NO: 1066 - DNA, 130 bp, Artificial Sequence
  Synthetic
cacatgattacgccaagctttgttgatacaaccataaaatgataattagtctaaacttcagtaagtttacgactcacaaccataagttgatattttctcttcatggtctaggatcccatgacatatcagg

SEQ ID NO: 1067 - DNA, 130 bp, Artificial Sequence
  Synthetic
cacatgattacgccaagctttgttgatacacccataaattgataattagtctaaacttcagtaagtttacgactcacaaccataagttgatattttctcttcatggtctaggatcccatgacatatcagg

SEQ ID NO: 1068 - DNA, 130 bp, Artificial Sequence
  Synthetic
cacatgattacgccaagctttgttgatacacccataaattgatattgcgtctaaacttcagtaagtttacgactcacaaccataagttgatattttctcttcatggtctaggatcccatgacatatcagg

SEQ ID NO: 1069 - DNA, 130 bp, Artificial Sequence
  Synthetic
cacatgattacgccaagctttgttgatagtctaaacttcagtaagtttacgacgtctaaacttcagtaagtttacgactcacaaccataagttgatattttctcttcatgggatcccatgacatatcagg

SEQ ID NO: 1070 - DNA, 130 bp, Artificial Sequence
  Synthetic
cacatgattacgccaagctttgttgatacaaccataagttgatattttgtctaaacttcagtaagtttacgactcacaaccataagttgatattttctcttcatggtctaggatcccatgacatatcagg

SEQ ID NO: 1071 - DNA, 130 bp, Artificial Sequence
  Synthetic
cacatgattacgccaagctttgttgatacaaccatatattgatatctcgtctaaacttcagtaagtttacgactcacaaccataagttgatattttctcttcatggtctaggatcccatgacatatcagg

SEQ ID NO: 1072 - DNA, 130 bp, Artificial Sequence
  Synthetic
cacatgattacgccaagctttgttgatacaaccataaagtgatatttagtctaaacttcagtaagtttacgactcacaaccataagttgatattttctcttcatggtctaggatcccatgacatatcagg

SEQ ID NO: 1073 - DNA, 130 bp, Artificial Sequence
  Synthetic
cacatgattacgccaagctttgttgatacaaccataaaatgataattacaaccataagttgatatttttcacaaccataagttgatattttctcttcatggtctaaacttggatcccatgacatatcagg

SEQ ID NO: 1074 - DNA, 130 bp, Artificial Sequence
  Synthetic
cacatgattacgccaagctttgttgatacacccataaattgataattacaaccataagttgatatttttcacaaccataagttgatattttctcttcatggtctaaacttggatcccatgacatatcagg

SEQ ID NO: 1075 - DNA, 130 bp, Artificial Sequence
  Synthetic
cacatgattacgccaagctttgttgatacacccataaattgatattgccaaccataagttgatatttttcacaaccataagttgatattttctcttcatggtctaaacttggatcccatgacatatcagg

SEQ ID NO: 1076 - DNA, 130 bp, Artificial Sequence
  Synthetic
cacatgattacgccaagctttgttgatagtctaaacttcagtaagtttacgaccaaccataagttgatatttttcacaaccataagttgatattttctcttcatggtctaggatcccatgacatatcagg

SEQ ID NO: 1077 - DNA, 130 bp, Artificial Sequence
  Synthetic
cacatgattacgccaagctttgttgatacaaccataagttgatattttcaaccataagttgatatttttcacaaccataagttgatattttctcttcatggtctaaacttggatcccatgacatatcagg

SEQ ID NO: 1078 - DNA, 130 bp, Artificial Sequence
  Synthetic
cacatgattacgccaagctttgttgatacaaccatatattgatatctccaaccataagttgatatttttcacaaccataagttgatattttctcttcatggtctaaacttggatcccatgacatatcagg

SEQ ID NO: 1079 - DNA, 130 bp, Artificial Sequence
  Synthetic
cacatgattacgccaagctttgttgatacaaccataaagtgatatttacaaccataagttgatatttttcacaaccataagttgatattttctcttcatggtctaaacttggatcccatgacatatcagg

SEQ ID NO: 1080 - DNA, 130 bp, Artificial Sequence
  Synthetic
cacatgattacgccaagctttgttgatacaaccataaaatgataattacaaccatatattgatatctctcacaaccataagttgatattttctcttcatggtctaaacttggatcccatgacatatcagg

SEQ ID NO: 1081 - DNA, 130 bp, Artificial Sequence
  Synthetic
cacatgattacgccaagctttgttgatacacccataaattgataattacaaccatatattgatatctctcacaaccataagttgatattttctcttcatggtctaaacttggatcccatgacatatcagg

SEQ ID NO: 1082 - DNA, 130 bp, Artificial Sequence
  Synthetic
cacatgattacgccaagctttgttgatacacccataaattgatattgccaaccatatattgatatctctcacaaccataagttgatattttctcttcatggtctaaacttggatcccatgacatatcagg

SEQ ID NO: 1083 - DNA, 130 bp, Artificial Sequence
  Synthetic
cacatgattacgccaagctttgttgatagtctaaacttcagtaagtttacgaccaaccatatattgatatctctcacaaccataagttgatattttctcttcatggtctaggatcccatgacatatcagg

SEQ ID NO: 1084 - DNA, 130 bp, Artificial Sequence
  Synthetic
cacatgattacgccaagctttgttgatacaaccataagttgatattttcaaccatatattgatatctctcacaaccataagttgatattttctcttcatggtctaaacttggatcccatgacatatcagg

SEQ ID NO: 1085 - DNA, 130 bp, Artificial Sequence
  Synthetic
cacatgattacgccaagctttgttgatacaaccatatattgatatctccaaccatatattgatatctctcacaaccataagttgatattttctcttcatggtctaaacttggatcccatgacatatcagg

SEQ ID NO: 1086 - DNA, 130 bp, Artificial Sequence
  Synthetic
cacatgattacgccaagctttgttgatacaaccataaagtgatatttacaaccatatattgatatctctcacaaccataagttgatattttctcttcatggtctaaacttggatcccatgacatatcagg

SEQ ID NO: 1087 - DNA, 130 bp, Artificial Sequence
  Synthetic
cacatgattacgccaagctttgttgatacaaccataaaatgataattacaaccataaagtgatatttatcacaaccataagttgatattttctcttcatggtctaaacttggatcccatgacatatcagg

SEQ ID NO: 1088 - DNA, 130 bp, Artificial Sequence
  Synthetic
cacatgattacgccaagctttgttgatacacccataaattgataattacaaccataaagtgatatttatcacaaccataagttgatattttctcttcatggtctaaacttggatcccatgacatatcagg

SEQ ID NO: 1089 - DNA, 130 bp, Artificial Sequence
  Synthetic
cacatgattacgccaagctttgttgatacacccataaattgatattgccaaccataaagtgatatttatcacaaccataagttgatattttctcttcatggtctaaacttggatcccatgacatatcagg

SEQ ID NO: 1090 - DNA, 130 bp, Artificial Sequence
  Synthetic
cacatgattacgccaagctttgttgatagtctaaacttcagtaagtttacgaccaaccataaagtgatatttatcacaaccataagttgatattttctcttcatggtctaggatcccatgacatatcagg

SEQ ID NO: 1091 - DNA, 130 bp, Artificial Sequence
  Synthetic
cacatgattacgccaagctttgttgatacaaccataagttgatattttcaaccataaagtgatatttatcacaaccataagttgatattttctcttcatggtctaaacttggatcccatgacatatcagg

SEQ ID NO: 1092 - DNA, 130 bp, Artificial Sequence
  Synthetic
cacatgattacgccaagctttgttgatacaaccatatattgatatctccaaccataaagtgatatttatcacaaccataagttgatattttctcttcatggtctaaacttggatcccatgacatatcagg

SEQ ID NO: 1093 - DNA, 130 bp, Artificial Sequence
  Synthetic
cacatgattacgccaagctttgttgatacaaccataaagtgatatttacaaccataaagtgatatttatcacaaccataagttgatattttctcttcatggtctaaacttggatcccatgacatatcagg

SEQ ID NO: 1094 - DNA, 130 bp, Artificial Sequence
  Synthetic
cacatgattacgccaagctttgttgatacaaccataaaatgataattacaaccataaaatgataattatcacaaccataagttgatattttctcttcatggtctaaacttggatcccatgacatatcagg

SEQ ID NO: 1095 - DNA, 130 bp, Artificial Sequence
  Synthetic
cacatgattacgccaagctttgttgatacacccataaattgataattacaaccataaaatgataattatcacaaccataagttgatattttctcttcatggtctaaacttggatcccatgacatatcagg

SEQ ID NO: 1096 - DNA, 130 bp, Artificial Sequence
  Synthetic
cacatgattacgccaagctttgttgatacacccataaattgatattgccaaccataaaatgataattatcacaaccataagttgatattttctcttcatggtctaaacttggatcccatgacatatcagg

SEQ ID NO: 1097 - DNA, 130 bp, Artificial Sequence
  Synthetic
cacatgattacgccaagctttgttgatagtctaaacttcagtaagtttacgaccaaccataaaatgataattatcacaaccataagttgatattttctcttcatggtctaggatcccatgacatatcagg

SEQ ID NO: 1098 - DNA, 130 bp, Artificial Sequence
  Synthetic
cacatgattacgccaagctttgttgatacaaccataagttgatattttcaaccataaaatgataattatcacaaccataagttgatattttctcttcatggtctaaacttggatcccatgacatatcagg

SEQ ID NO: 1099 - DNA, 130 bp, Artificial Sequence
  Synthetic
cacatgattacgccaagctttgttgatacaaccatatattgatatctccaaccataaaatgataattatcacaaccataagttgatattttctcttcatggtctaaacttggatcccatgacatatcagg

SEQ ID NO: 1100 - DNA, 130 bp, Artificial Sequence
  Synthetic
cacatgattacgccaagctttgttgatacaaccataaagtgatatttacaaccataaaatgataattatcacaaccataagttgatattttctcttcatggtctaaacttggatcccatgacatatcagg

SEQ ID NO: 1101 - DNA, 130 bp, Artificial Sequence
  Synthetic
cacatgattacgccaagctttgttgatacaaccataaaatgataattacacccataaattgataattatcacaaccatatattgatatctcctcttcatggtctaaacttggatcccatgacatatcagg

SEQ ID NO: 1102 - DNA, 130 bp, Artificial Sequence
  Synthetic
cacatgattacgccaagctttgttgatacacccataaattgataattacacccataaattgataattatcacaaccatatattgatatctcctcttcatggtctaaacttggatcccatgacatatcagg

SEQ ID NO: 1103 - DNA, 130 bp, Artificial Sequence
  Synthetic
cacatgattacgccaagctttgttgatacacccataaattgatattgccacccataaattgataattatcacaaccatatattgatatctcctcttcatggtctaaacttggatcccatgacatatcagg

SEQ ID NO: 1104 - DNA, 130 bp, Artificial Sequence
  Synthetic
cacatgattacgccaagctttgttgatagtctaaacttcagtaagtttacgaccacccataaattgataattatcacaaccatatattgatatctcctcttcatggtctaggatcccatgacatatcagg

SEQ ID NO: 1105 - DNA, 130 bp, Artificial Sequence
  Synthetic
cacatgattacgccaagctttgttgatacaaccataagttgatattttcacccataaattgataattatcacaaccatatattgatatctcctcttcatggtctaaacttggatcccatgacatatcagg

SEQ ID NO: 1106 - DNA, 130 bp, Artificial Sequence
  Synthetic
cacatgattacgccaagctttgttgatacaaccatatattgatatctccacccataaattgataattatcacaaccatatattgatatctcctcttcatggtctaaacttggatcccatgacatatcagg

SEQ ID NO: 1107 - DNA, 130 bp, Artificial Sequence
  Synthetic
cacatgattacgccaagctttgttgatacaaccataaagtgatatttacacccataaattgataattatcacaaccatatattgatatctcctcttcatggtctaaacttggatcccatgacatatcagg

SEQ ID NO: 1108 - DNA, 130 bp, Artificial Sequence
  Synthetic
cacatgattacgccaagctttgttgatacaaccataaaatgataattacacccataaattgatattgctcacaaccatatattgatatctcctcttcatggtctaaacttggatcccatgacatatcagg

SEQ ID NO: 1109 - DNA, 130 bp, Artificial Sequence
  Synthetic
cacatgattacgccaagctttgttgatacacccataaattgataattacacccataaattgatattgctcacaaccatatattgatatctcctcttcatggtctaaacttggatcccatgacatatcagg

SEQ ID NO: 1110 - DNA, 130 bp, Artificial Sequence
  Synthetic
cacatgattacgccaagctttgttgatacacccataaattgatattgccacccataaattgatattgctcacaaccatatattgatatctcctcttcatggtctaaacttggatcccatgacatatcagg

SEQ ID NO: 1111 - DNA, 130 bp, Artificial Sequence
  Synthetic
cacatgattacgccaagctttgttgatagtctaaacttcagtaagtttacgaccacccataaattgatattgctcacaaccatatattgatatctcctcttcatggtctaggatcccatgacatatcagg

SEQ ID NO: 1112 - DNA, 130 bp, Artificial Sequence
  Synthetic
cacatgattacgccaagctttgttgatacaaccataagttgatattttcacccataaattgatattgctcacaaccatatattgatatctcctcttcatggtctaaacttggatcccatgacatatcagg

SEQ ID NO: 1113 - DNA, 130 bp, Artificial Sequence
  Synthetic
cacatgattacgccaagctttgttgatacaaccatatattgatatctccacccataaattgatattgctcacaaccatatattgatatctcctcttcatggtctaaacttggatcccatgacatatcagg

SEQ ID NO: 1114 - DNA, 130 bp, Artificial Sequence
  Synthetic
cacatgattacgccaagctttgttgatacaaccataaagtgatatttacacccataaattgatattgctcacaaccatatattgatatctcctcttcatggtctaaacttggatcccatgacatatcagg

SEQ ID NO: 1115 - DNA, 130 bp, Artificial Sequence
  Synthetic
cacatgattacgccaagctttgttgatacaaccataaaatgataattagtctaaacttcagtaagtttacgactcacaaccatatattgatatctcctcttcatggtctaggatcccatgacatatcagg

SEQ ID NO: 1116 - DNA, 130 bp, Artificial Sequence
  Synthetic
cacatgattacgccaagctttgttgatacacccataaattgataattagtctaaacttcagtaagtttacgactcacaaccatatattgatatctcctcttcatggtctaggatcccatgacatatcagg

SEQ ID NO: 1117 - DNA, 130 bp, Artificial Sequence
  Synthetic
cacatgattacgccaagctttgttgatacacccataaattgatattgcgtctaaacttcagtaagtttacgactcacaaccatatattgatatctcctcttcatggtctaggatcccatgacatatcagg

SEQ ID NO: 1118 - DNA, 130 bp, Artificial Sequence
  Synthetic
cacatgattacgccaagctttgttgatagtctaaacttcagtaagtttacgacgtctaaacttcagtaagtttacgactcacaaccatatattgatatctcctcttcatgggatcccatgacatatcagg

SEQ ID NO: 1119 - DNA, 130 bp, Artificial Sequence
  Synthetic
cacatgattacgccaagctttgttgatacaaccataagttgatattttgtctaaacttcagtaagtttacgactcacaaccatatattgatatctcctcttcatggtctaggatcccatgacatatcagg

SEQ ID NO: 1120 - DNA, 130 bp, Artificial Sequence
  Synthetic
cacatgattacgccaagctttgttgatacaaccatatattgatatctcgtctaaacttcagtaagtttacgactcacaaccatatattgatatctcctcttcatggtctaggatcccatgacatatcagg

SEQ ID NO: 1121 - DNA, 130 bp, Artificial Sequence
  Synthetic
cacatgattacgccaagctttgttgatacaaccataaagtgatatttagtctaaacttcagtaagtttacgactcacaaccatatattgatatctcctcttcatggtctaggatcccatgacatatcagg

SEQ ID NO: 1122 - DNA, 130 bp, Artificial Sequence
  Synthetic
cacatgattacgccaagctttgttgatacaaccataaaatgataattacaaccataagttgatatttttcacaaccatatattgatatctcctcttcatggtctaaacttggatcccatgacatatcagg

SEQ ID NO: 1123 - DNA, 130 bp, Artificial Sequence
  Synthetic
cacatgattacgccaagctttgttgatacacccataaattgataattacaaccataagttgatatttttcacaaccatatattgatatctcctcttcatggtctaaacttggatcccatgacatatcagg

SEQ ID NO: 1124 - DNA, 130 bp, Artificial Sequence
  Synthetic
cacatgattacgccaagctttgttgatacacccataaattgatattgccaaccataagttgatatttttcacaaccatatattgatatctcctcttcatggtctaaacttggatcccatgacatatcagg

SEQ ID NO: 1125 - DNA, 130 bp, Artificial Sequence
  Synthetic
cacatgattacgccaagctttgttgatagtctaaacttcagtaagtttacgaccaaccataagttgatatttttcacaaccatatattgatatctcctcttcatggtctaggatcccatgacatatcagg

SEQ ID NO: 1126 - DNA, 130 bp, Artificial Sequence
  Synthetic
cacatgattacgccaagctttgttgatacaaccataagttgatattttcaaccataagttgatatttttcacaaccatatattgatatctcctcttcatggtctaaacttggatcccatgacatatcagg

SEQ ID NO: 1127 - DNA, 130 bp, Artificial Sequence
  Synthetic
cacatgattacgccaagctttgttgatacaaccatatattgatatctccaaccataagttgatatttttcacaaccatatattgatatctcctcttcatggtctaaacttggatcccatgacatatcagg

SEQ ID NO: 1128 - DNA, 130 bp, Artificial Sequence
  Synthetic
cacatgattacgccaagctttgttgatacaaccataaagtgatatttacaaccataagttgatatttttcacaaccatatattgatatctcctcttcatggtctaaacttggatcccatgacatatcagg

SEQ ID NO: 1129 - DNA, 130 bp, Artificial Sequence
  Synthetic
cacatgattacgccaagctttgttgatacaaccataaaatgataattacaaccatatattgatatctctcacaaccatatattgatatctcctcttcatggtctaaacttggatcccatgacatatcagg

SEQ ID NO: 1130 - DNA, 130 bp, Artificial Sequence
  Synthetic
cacatgattacgccaagctttgttgatacacccataaattgataattacaaccatatattgatatctctcacaaccatatattgatatctcctcttcatggtctaaacttggatcccatgacatatcagg

SEQ ID NO: 1131 - DNA, 130 bp, Artificial Sequence
  Synthetic
cacatgattacgccaagctttgttgatacacccataaattgatattgccaaccatatattgatatctctcacaaccatatattgatatctcctcttcatggtctaaacttggatcccatgacatatcagg

SEQ ID NO: 1132 - DNA, 130 bp, Artificial Sequence
  Synthetic
cacatgattacgccaagctttgttgatagtctaaacttcagtaagtttacgaccaaccatatattgatatctctcacaaccatatattgatatctcctcttcatggtctaggatcccatgacatatcagg

SEQ ID NO: 1133 - DNA, 130 bp, Artificial Sequence
  Synthetic
cacatgattacgccaagctttgttgatacaaccataagttgatattttcaaccatatattgatatctctcacaaccatatattgatatctcctcttcatggtctaaacttggatcccatgacatatcagg

SEQ ID NO: 1134 - DNA, 130 bp, Artificial Sequence
  Synthetic
cacatgattacgccaagctttgttgatacaaccatatattgatatctccaaccatatattgatatctctcacaaccatatattgatatctcctcttcatggtctaaacttggatcccatgacatatcagg

SEQ ID NO: 1135 - DNA, 130 bp, Artificial Sequence
  Synthetic
cacatgattacgccaagctttgttgatacaaccataaagtgatatttacaaccatatattgatatctctcacaaccatatattgatatctcctcttcatggtctaaacttggatcccatgacatatcagg

SEQ ID NO: 1136 - DNA, 130 bp, Artificial Sequence
  Synthetic
cacatgattacgccaagctttgttgatacaaccataaaatgataattacaaccataaagtgatatttatcacaaccatatattgatatctcctcttcatggtctaaacttggatcccatgacatatcagg

SEQ ID NO: 1137 - DNA, 130 bp, Artificial Sequence
  Synthetic
cacatgattacgccaagctttgttgatacacccataaattgataattacaaccataaagtgatatttatcacaaccatatattgatatctcctcttcatggtctaaacttggatcccatgacatatcagg

SEQ ID NO: 1138 - DNA, 130 bp, Artificial Sequence
  Synthetic
cacatgattacgccaagctttgttgatacacccataaattgatattgccaaccataaagtgatatttatcacaaccatatattgatatctcctcttcatggtctaaacttggatcccatgacatatcagg

SEQ ID NO: 1139 - DNA, 130 bp, Artificial Sequence
  Synthetic
cacatgattacgccaagctttgttgatagtctaaacttcagtaagtttacgaccaaccataaagtgatatttatcacaaccatatattgatatctcctcttcatggtctaggatcccatgacatatcagg

SEQ ID NO: 1140 - DNA, 130 bp, Artificial Sequence
  Synthetic
cacatgattacgccaagctttgttgatacaaccataagttgatattttcaaccataaagtgatatttatcacaaccatatattgatatctcctcttcatggtctaaacttggatcccatgacatatcagg

SEQ ID NO: 1141 - DNA, 130 bp, Artificial Sequence
  Synthetic
cacatgattacgccaagctttgttgatacaaccatatattgatatctccaaccataaagtgatatttatcacaaccatatattgatatctcctcttcatggtctaaacttggatcccatgacatatcagg

SEQ ID NO: 1142 - DNA, 130 bp, Artificial Sequence
  Synthetic
cacatgattacgccaagctttgttgatacaaccataaagtgatatttacaaccataaagtgatatttatcacaaccatatattgatatctcctcttcatggtctaaacttggatcccatgacatatcagg

SEQ ID NO: 1143 - DNA, 130 bp, Artificial Sequence
  Synthetic
cacatgattacgccaagctttgttgatacaaccataaaatgataattacaaccataaaatgataattatcacaaccatatattgatatctcctcttcatggtctaaacttggatcccatgacatatcagg

SEQ ID NO: 1144 - DNA, 130 bp, Artificial Sequence
  Synthetic
cacatgattacgccaagctttgttgatacacccataaattgataattacaaccataaaatgataattatcacaaccatatattgatatctcctcttcatggtctaaacttggatcccatgacatatcagg

SEQ ID NO: 1145 - DNA, 130 bp, Artificial Sequence
  Synthetic
cacatgattacgccaagctttgttgatacacccataaattgatattgccaaccataaaatgataattatcacaaccatatattgatatctcctcttcatggtctaaacttggatcccatgacatatcagg

SEQ ID NO: 1146 - DNA, 130 bp, Artificial Sequence
  Synthetic
cacatgattacgccaagctttgttgatagtctaaacttcagtaagtttacgaccaaccataaaatgataattatcacaaccatatattgatatctcctcttcatggtctaggatcccatgacatatcagg

SEQ ID NO: 1147 - DNA, 130 bp, Artificial Sequence
  Synthetic
cacatgattacgccaagctttgttgatacaaccataagttgatattttcaaccataaaatgataattatcacaaccatatattgatatctcctcttcatggtctaaacttggatcccatgacatatcagg

SEQ ID NO: 1148 - DNA, 130 bp, Artificial Sequence
  Synthetic
cacatgattacgccaagctttgttgatacaaccatatattgatatctccaaccataaaatgataattatcacaaccatatattgatatctcctcttcatggtctaaacttggatcccatgacatatcagg

SEQ ID NO: 1149 - DNA, 130 bp, Artificial Sequence
  Synthetic
cacatgattacgccaagctttgttgatacaaccataaagtgatatttacaaccataaaatgataattatcacaaccatatattgatatctcctcttcatggtctaaacttggatcccatgacatatcagg

SEQ ID NO: 1150 - DNA, 130 bp, Artificial Sequence
  Synthetic
cacatgattacgccaagctttgttgatacaaccataaaatgataattacacccataaattgataattatcacaaccataaagtgatatttactcttcatggtctaaacttggatcccatgacatatcagg

SEQ ID NO: 1151 - DNA, 130 bp, Artificial Sequence
  Synthetic
cacatgattacgccaagctttgttgatacacccataaattgataattacacccataaattgataattatcacaaccataaagtgatatttactcttcatggtctaaacttggatcccatgacatatcagg

SEQ ID NO: 1152 - DNA, 130 bp, Artificial Sequence
  Synthetic
cacatgattacgccaagctttgttgatacacccataaattgatattgccacccataaattgataattatcacaaccataaagtgatatttactcttcatggtctaaacttggatcccatgacatatcagg

SEQ ID NO: 1153 - DNA, 130 bp, Artificial Sequence
  Synthetic
cacatgattacgccaagctttgttgatagtctaaacttcagtaagtttacgaccacccataaattgataattatcacaaccataaagtgatatttactcttcatggtctaggatcccatgacatatcagg

SEQ ID NO: 1154 - DNA, 130 bp, Artificial Sequence
  Synthetic
cacatgattacgccaagctttgttgatacaaccataagttgatattttcacccataaattgataattatcacaaccataaagtgatatttactcttcatggtctaaacttggatcccatgacatatcagg

SEQ ID NO: 1155 - DNA, 130 bp, Artificial Sequence
  Synthetic
cacatgattacgccaagctttgttgatacaaccatatattgatatctccacccataaattgataattatcacaaccataaagtgatatttactcttcatggtctaaacttggatcccatgacatatcagg

SEQ ID NO: 1156 - DNA, 130 bp, Artificial Sequence
  Synthetic
cacatgattacgccaagctttgttgatacaaccataaagtgatatttacacccataaattgataattatcacaaccataaagtgatatttactcttcatggtctaaacttggatcccatgacatatcagg

SEQ ID NO: 1157 - DNA, 130 bp, Artificial Sequence
  Synthetic
cacatgattacgccaagctttgttgatacaaccataaaatgataattacacccataaattgatattgctcacaaccataaagtgatatttactcttcatggtctaaacttggatcccatgacatatcagg

SEQ ID NO: 1158 - DNA, 130 bp, Artificial Sequence
  Synthetic
cacatgattacgccaagctttgttgatacacccataaattgataattacacccataaattgatattgctcacaaccataaagtgatatttactcttcatggtctaaacttggatcccatgacatatcagg

SEQ ID NO: 1159 - DNA, 130 bp, Artificial Sequence
  Synthetic
cacatgattacgccaagctttgttgatacacccataaattgatattgccacccataaattgatattgctcacaaccataaagtgatatttactcttcatggtctaaacttggatcccatgacatatcagg

SEQ ID NO: 1160 - DNA, 130 bp, Artificial Sequence
  Synthetic
cacatgattacgccaagctttgttgatagtctaaacttcagtaagtttacgaccacccataaattgatattgctcacaaccataaagtgatatttactcttcatggtctaggatcccatgacatatcagg

SEQ ID NO: 1161 - DNA, 130 bp, Artificial Sequence
  Synthetic
cacatgattacgccaagctttgttgatacaaccataagttgatattttcacccataaattgatattgctcacaaccataaagtgatatttactcttcatggtctaaacttggatcccatgacatatcagg

SEQ ID NO: 1162 - DNA, 130 bp, Artificial Sequence
  Synthetic
cacatgattacgccaagctttgttgatacaaccatatattgatatctccacccataaattgatattgctcacaaccataaagtgatatttactcttcatggtctaaacttggatcccatgacatatcagg

SEQ ID NO: 1163 - DNA, 130 bp, Artificial Sequence
  Synthetic
cacatgattacgccaagctttgttgatacaaccataaagtgatatttacacccataaattgatattgctcacaaccataaagtgatatttactcttcatggtctaaacttggatcccatgacatatcagg

SEQ ID NO: 1164 - DNA, 130 bp, Artificial Sequence
  Synthetic
cacatgattacgccaagctttgttgatacaaccataaaatgataattagtctaaacttcagtaagtttacgactcacaaccataaagtgatatttactcttcatggtctaggatcccatgacatatcagg

SEQ ID NO: 1165 - DNA, 130 bp, Artificial Sequence
  Synthetic
cacatgattacgccaagctttgttgatacacccataaattgataattagtctaaacttcagtaagtttacgactcacaaccataaagtgatatttactcttcatggtctaggatcccatgacatatcagg

SEQ ID NO: 1166 - DNA, 130 bp, Artificial Sequence
  Synthetic
cacatgattacgccaagctttgttgatacacccataaattgatattgcgtctaaacttcagtaagtttacgactcacaaccataaagtgatatttactcttcatggtctaggatcccatgacatatcagg

SEQ ID NO: 1167 - DNA, 130 bp, Artificial Sequence
  Synthetic
cacatgattacgccaagctttgttgatagtctaaacttcagtaagtttacgacgtctaaacttcagtaagtttacgactcacaaccataaagtgatatttactcttcatgggatcccatgacatatcagg

SEQ ID NO: 1168 - DNA, 130 bp, Artificial Sequence
  Synthetic
cacatgattacgccaagctttgttgatacaaccataagttgatattttgtctaaacttcagtaagtttacgactcacaaccataaagtgatatttactcttcatggtctaggatcccatgacatatcagg

SEQ ID NO: 1169 - DNA, 130 bp, Artificial Sequence
  Synthetic
cacatgattacgccaagctttgttgatacaaccatatattgatatctcgtctaaacttcagtaagtttacgactcacaaccataaagtgatatttactcttcatggtctaggatcccatgacatatcagg

SEQ ID NO: 1170 - DNA, 130 bp, Artificial Sequence
  Synthetic
cacatgattacgccaagctttgttgatacaaccataaagtgatatttagtctaaacttcagtaagtttacgactcacaaccataaagtgatatttactcttcatggtctaggatcccatgacatatcagg

SEQ ID NO: 1171 - DNA, 130 bp, Artificial Sequence
  Synthetic
cacatgattacgccaagctttgttgatacaaccataaaatgataattacaaccataagttgatatttttcacaaccataaagtgatatttactcttcatggtctaaacttggatcccatgacatatcagg

SEQ ID NO: 1172 - DNA, 130 bp, Artificial Sequence
  Synthetic
cacatgattacgccaagctttgttgatacacccataaattgataattacaaccataagttgatatttttcacaaccataaagtgatatttactcttcatggtctaaacttggatcccatgacatatcagg

SEQ ID NO: 1173 - DNA, 130 bp, Artificial Sequence
  Synthetic
cacatgattacgccaagctttgttgatacacccataaattgatattgccaaccataagttgatatttttcacaaccataaagtgatatttactcttcatggtctaaacttggatcccatgacatatcagg

SEQ ID NO: 1174 - DNA, 130 bp, Artificial Sequence
  Synthetic
cacatgattacgccaagctttgttgatagtctaaacttcagtaagtttacgaccaaccataagttgatatttttcacaaccataaagtgatatttactcttcatggtctaggatcccatgacatatcagg

SEQ ID NO: 1175 - DNA, 130 bp, Artificial Sequence
  Synthetic
cacatgattacgccaagctttgttgatacaaccataagttgatattttcaaccataagttgatatttttcacaaccataaagtgatatttactcttcatggtctaaacttggatcccatgacatatcagg

SEQ ID NO: 1176 - DNA, 130 bp, Artificial Sequence
  Synthetic
cacatgattacgccaagctttgttgatacaaccatatattgatatctccaaccataagttgatatttttcacaaccataaagtgatatttactcttcatggtctaaacttggatcccatgacatatcagg

SEQ ID NO: 1177 - DNA, 130 bp, Artificial Sequence
  Synthetic
cacatgattacgccaagctttgttgatacaaccataaagtgatatttacaaccataagttgatatttttcacaaccataaagtgatatttactcttcatggtctaaacttggatcccatgacatatcagg

SEQ ID NO: 1178 - DNA, 130 bp, Artificial Sequence
  Synthetic
cacatgattacgccaagctttgttgatacaaccataaaatgataattacaaccatatattgatatctctcacaaccataaagtgatatttactcttcatggtctaaacttggatcccatgacatatcagg

SEQ ID NO: 1179 - DNA, 130 bp, Artificial Sequence
  Synthetic
cacatgattacgccaagctttgttgatacacccataaattgataattacaaccatatattgatatctctcacaaccataaagtgatatttactcttcatggtctaaacttggatcccatgacatatcagg

SEQ ID NO: 1180 - DNA, 130 bp, Artificial Sequence
  Synthetic
cacatgattacgccaagctttgttgatacacccataaattgatattgccaaccatatattgatatctctcacaaccataaagtgatatttactcttcatggtctaaacttggatcccatgacatatcagg

SEQ ID NO: 1181 - DNA, 130 bp, Artificial Sequence
  Synthetic
cacatgattacgccaagctttgttgatagtctaaacttcagtaagtttacgaccaaccatatattgatatctctcacaaccataaagtgatatttactcttcatggtctaggatcccatgacatatcagg

SEQ ID NO: 1182 - DNA, 130 bp, Artificial Sequence
  Synthetic
cacatgattacgccaagctttgttgatacaaccataagttgatattttcaaccatatattgatatctctcacaaccataaagtgatatttactcttcatggtctaaacttggatcccatgacatatcagg

SEQ ID NO: 1183 - DNA, 130 bp, Artificial Sequence
  Synthetic
cacatgattacgccaagctttgttgatacaaccatatattgatatctccaaccatatattgatatctctcacaaccataaagtgatatttactcttcatggtctaaacttggatcccatgacatatcagg

SEQ ID NO: 1184 - DNA, 130 bp, Artificial Sequence
  Synthetic
cacatgattacgccaagctttgttgatacaaccataaagtgatatttacaaccatatattgatatctctcacaaccataaagtgatatttactcttcatggtctaaacttggatcccatgacatatcagg

SEQ ID NO: 1185 - DNA, 130 bp, Artificial Sequence
  Synthetic
cacatgattacgccaagctttgttgatacaaccataaaatgataattacaaccataaagtgatatttatcacaaccataaagtgatatttactcttcatggtctaaacttggatcccatgacatatcagg

SEQ ID NO: 1186 - DNA, 130 bp, Artificial Sequence
  Synthetic
cacatgattacgccaagctttgttgatacacccataaattgataattacaaccataaagtgatatttatcacaaccataaagtgatatttactcttcatggtctaaacttggatcccatgacatatcagg

SEQ ID NO: 1187 - DNA, 130 bp, Artificial Sequence
  Synthetic
cacatgattacgccaagctttgttgatacacccataaattgatattgccaaccataaagtgatatttatcacaaccataaagtgatatttactcttcatggtctaaacttggatcccatgacatatcagg

SEQ ID NO: 1188 - DNA, 130 bp, Artificial Sequence
  Synthetic
cacatgattacgccaagctttgttgatagtctaaacttcagtaagtttacgaccaaccataaagtgatatttatcacaaccataaagtgatatttactcttcatggtctaggatcccatgacatatcagg

SEQ ID NO: 1189 - DNA, 130 bp, Artificial Sequence
  Synthetic
cacatgattacgccaagctttgttgatacaaccataagttgatattttcaaccataaagtgatatttatcacaaccataaagtgatatttactcttcatggtctaaacttggatcccatgacatatcagg

SEQ ID NO: 1190 - DNA, 130 bp, Artificial Sequence
  Synthetic
cacatgattacgccaagctttgttgatacaaccatatattgatatctccaaccataaagtgatatttatcacaaccataaagtgatatttactcttcatggtctaaacttggatcccatgacatatcagg

SEQ ID NO: 1191 - DNA, 130 bp, Artificial Sequence
  Synthetic
cacatgattacgccaagctttgttgatacaaccataaagtgatatttacaaccataaagtgatatttatcacaaccataaagtgatatttactcttcatggtctaaacttggatcccatgacatatcagg

SEQ ID NO: 1192 - DNA, 130 bp, Artificial Sequence
  Synthetic
cacatgattacgccaagctttgttgatacaaccataaaatgataattacaaccataaaatgataattatcacaaccataaagtgatatttactcttcatggtctaaacttggatcccatgacatatcagg

SEQ ID NO: 1193 - DNA, 130 bp, Artificial Sequence
  Synthetic
cacatgattacgccaagctttgttgatacacccataaattgataattacaaccataaaatgataattatcacaaccataaagtgatatttactcttcatggtctaaacttggatcccatgacatatcagg

SEQ ID NO: 1194 - DNA, 130 bp, Artificial Sequence
  Synthetic
cacatgattacgccaagctttgttgatacacccataaattgatattgccaaccataaaatgataattatcacaaccataaagtgatatttactcttcatggtctaaacttggatcccatgacatatcagg

SEQ ID NO: 1195 - DNA, 130 bp, Artificial Sequence
  Synthetic
cacatgattacgccaagctttgttgatagtctaaacttcagtaagtttacgaccaaccataaaatgataattatcacaaccataaagtgatatttactcttcatggtctaggatcccatgacatatcagg

SEQ ID NO: 1196 - DNA, 130 bp, Artificial Sequence
  Synthetic
cacatgattacgccaagctttgttgatacaaccataagttgatattttcaaccataaaatgataattatcacaaccataaagtgatatttactcttcatggtctaaacttggatcccatgacatatcagg

SEQ ID NO: 1197 - DNA, 130 bp, Artificial Sequence
  Synthetic
cacatgattacgccaagctttgttgatacaaccatatattgatatctccaaccataaaatgataattatcacaaccataaagtgatatttactcttcatggtctaaacttggatcccatgacatatcagg

SEQ ID NO: 1198 - DNA, 130 bp, Artificial Sequence
  Synthetic
cacatgattacgccaagctttgttgatacaaccataaagtgatatttacaaccataaaatgataattatcacaaccataaagtgatatttactcttcatggtctaaacttggatcccatgacatatcagg

SEQ ID NO: 1199 - DNA, 130 bp, Artificial Sequence
  Synthetic
cacatgattacgccaagctttgttgatacaaccataaaatgataattacacccataaattgataattatcacaaccataaaatgataattactcttcatggtctaaacttggatcccatgacatatcagg

SEQ ID NO: 1200 - DNA, 130 bp, Artificial Sequence
  Synthetic
cacatgattacgccaagctttgttgatacacccataaattgataattacacccataaattgataattatcacaaccataaaatgataattactcttcatggtctaaacttggatcccatgacatatcagg

SEQ ID NO: 1201 - DNA, 130 bp, Artificial Sequence
  Synthetic
cacatgattacgccaagctttgttgatacacccataaattgatattgccacccataaattgataattatcacaaccataaaatgataattactcttcatggtctaaacttggatcccatgacatatcagg

SEQ ID NO: 1202 - DNA, 130 bp, Artificial Sequence
  Synthetic
cacatgattacgccaagctttgttgatagtctaaacttcagtaagtttacgaccacccataaattgataattatcacaaccataaaatgataattactcttcatggtctaggatcccatgacatatcagg

SEQ ID NO: 1203 - DNA, 130 bp, Artificial Sequence
  Synthetic
cacatgattacgccaagctttgttgatacaaccataagttgatattttcacccataaattgataattatcacaaccataaaatgataattactcttcatggtctaaacttggatcccatgacatatcagg

SEQ ID NO: 1204 - DNA, 130 bp, Artificial Sequence
  Synthetic
cacatgattacgccaagctttgttgatacaaccatatattgatatctccacccataaattgataattatcacaaccataaaatgataattactcttcatggtctaaacttggatcccatgacatatcagg

SEQ ID NO: 1205 - DNA, 130 bp, Artificial Sequence
  Synthetic
cacatgattacgccaagctttgttgatacaaccataaagtgatatttacacccataaattgataattatcacaaccataaaatgataattactcttcatggtctaaacttggatcccatgacatatcagg

SEQ ID NO: 1206 - DNA, 130 bp, Artificial Sequence
  Synthetic
cacatgattacgccaagctttgttgatacaaccataaaatgataattacacccataaattgatattgctcacaaccataaaatgataattactcttcatggtctaaacttggatcccatgacatatcagg

SEQ ID NO: 1207 - DNA, 130 bp, Artificial Sequence
  Synthetic
cacatgattacgccaagctttgttgatacacccataaattgataattacacccataaattgatattgctcacaaccataaaatgataattactcttcatggtctaaacttggatcccatgacatatcagg

SEQ ID NO: 1208 - DNA, 130 bp, Artificial Sequence
  Synthetic
cacatgattacgccaagctttgttgatacacccataaattgatattgccacccataaattgatattgctcacaaccataaaatgataattactcttcatggtctaaacttggatcccatgacatatcagg

SEQ ID NO: 1209 - DNA, 130 bp, Artificial Sequence
  Synthetic
cacatgattacgccaagctttgttgatagtctaaacttcagtaagtttacgaccacccataaattgatattgctcacaaccataaaatgataattactcttcatggtctaggatcccatgacatatcagg

SEQ ID NO: 1210 - DNA, 130 bp, Artificial Sequence
  Synthetic
cacatgattacgccaagctttgttgatacaaccataagttgatattttcacccataaattgatattgctcacaaccataaaatgataattactcttcatggtctaaacttggatcccatgacatatcagg

SEQ ID NO: 1211 - DNA, 130 bp, Artificial Sequence
  Synthetic
cacatgattacgccaagctttgttgatacaaccatatattgatatctccacccataaattgatattgctcacaaccataaaatgataattactcttcatggtctaaacttggatcccatgacatatcagg

SEQ ID NO: 1212 - DNA, 130 bp, Artificial Sequence
  Synthetic
cacatgattacgccaagctttgttgatacaaccataaagtgatatttacacccataaattgatattgctcacaaccataaaatgataattactcttcatggtctaaacttggatcccatgacatatcagg

SEQ ID NO: 1213 - DNA, 130 bp, Artificial Sequence
  Synthetic
cacatgattacgccaagctttgttgatacaaccataaaatgataattagtctaaacttcagtaagtttacgactcacaaccataaaatgataattactcttcatggtctaggatcccatgacatatcagg

SEQ ID NO: 1214 - DNA, 130 bp, Artificial Sequence
  Synthetic
cacatgattacgccaagctttgttgatacacccataaattgataattagtctaaacttcagtaagtttacgactcacaaccataaaatgataattactcttcatggtctaggatcccatgacatatcagg

SEQ ID NO: 1215 - DNA, 130 bp, Artificial Sequence
  Synthetic
cacatgattacgccaagctttgttgatacacccataaattgatattgcgtctaaacttcagtaagtttacgactcacaaccataaaatgataattactcttcatggtctaggatcccatgacatatcagg

SEQ ID NO: 1216 - DNA, 130 bp, Artificial Sequence
  Synthetic
cacatgattacgccaagctttgttgatagtctaaacttcagtaagtttacgacgtctaaacttcagtaagtttacgactcacaaccataaaatgataattactcttcatgggatcccatgacatatcagg

SEQ ID NO: 1217 - DNA, 130 bp, Artificial Sequence
  Synthetic
cacatgattacgccaagctttgttgatacaaccataagttgatattttgtctaaacttcagtaagtttacgactcacaaccataaaatgataattactcttcatggtctaggatcccatgacatatcagg

SEQ ID NO: 1218 - DNA, 130 bp, Artificial Sequence
  Synthetic
cacatgattacgccaagctttgttgatacaaccatatattgatatctcgtctaaacttcagtaagtttacgactcacaaccataaaatgataattactcttcatggtctaggatcccatgacatatcagg

SEQ ID NO: 1219 - DNA, 130 bp, Artificial Sequence
  Synthetic
cacatgattacgccaagctttgttgatacaaccataaagtgatatttagtctaaacttcagtaagtttacgactcacaaccataaaatgataattactcttcatggtctaggatcccatgacatatcagg

SEQ ID NO: 1220 - DNA, 130 bp, Artificial Sequence
  Synthetic
cacatgattacgccaagctttgttgatacaaccataaaatgataattacaaccataagttgatatttttcacaaccataaaatgataattactcttcatggtctaaacttggatcccatgacatatcagg

SEQ ID NO: 1221 - DNA, 130 bp, Artificial Sequence
  Synthetic
cacatgattacgccaagctttgttgatacacccataaattgataattacaaccataagttgatatttttcacaaccataaaatgataattactcttcatggtctaaacttggatcccatgacatatcagg

SEQ ID NO: 1222 - DNA, 130 bp, Artificial Sequence
  Synthetic
cacatgattacgccaagctttgttgatacacccataaattgatattgccaaccataagttgatatttttcacaaccataaaatgataattactcttcatggtctaaacttggatcccatgacatatcagg

SEQ ID NO: 1223 - DNA, 130 bp, Artificial Sequence
  Synthetic
cacatgattacgccaagctttgttgatagtctaaacttcagtaagtttacgaccaaccataagttgatatttttcacaaccataaaatgataattactcttcatggtctaggatcccatgacatatcagg

SEQ ID NO: 1224 - DNA, 130 bp, Artificial Sequence
  Synthetic
cacatgattacgccaagctttgttgatacaaccataagttgatattttcaaccataagttgatatttttcacaaccataaaatgataattactcttcatggtctaaacttggatcccatgacatatcagg

SEQ ID NO: 1225 - DNA, 130 bp, Artificial Sequence
  Synthetic
cacatgattacgccaagctttgttgatacaaccatatattgatatctccaaccataagttgatatttttcacaaccataaaatgataattactcttcatggtctaaacttggatcccatgacatatcagg

SEQ ID NO: 1226 - DNA, 130 bp, Artificial Sequence
  Synthetic
cacatgattacgccaagctttgttgatacaaccataaagtgatatttacaaccataagttgatatttttcacaaccataaaatgataattactcttcatggtctaaacttggatcccatgacatatcagg

SEQ ID NO: 1227 - DNA, 130 bp, Artificial Sequence
  Synthetic
cacatgattacgccaagctttgttgatacaaccataaaatgataattacaaccatatattgatatctctcacaaccataaaatgataattactcttcatggtctaaacttggatcccatgacatatcagg

SEQ ID NO: 1228 - DNA, 130 bp, Artificial Sequence
  Synthetic
cacatgattacgccaagctttgttgatacacccataaattgataattacaaccatatattgatatctctcacaaccataaaatgataattactcttcatggtctaaacttggatcccatgacatatcagg

SEQ ID NO: 1229 - DNA, 130 bp, Artificial Sequence
  Synthetic
cacatgattacgccaagctttgttgatacacccataaattgatattgccaaccatatattgatatctctcacaaccataaaatgataattactcttcatggtctaaacttggatcccatgacatatcagg

SEQ ID NO: 1230 - DNA, 130 bp, Artificial Sequence
  Synthetic
cacatgattacgccaagctttgttgatagtctaaacttcagtaagtttacgaccaaccatatattgatatctctcacaaccataaaatgataattactcttcatggtctaggatcccatgacatatcagg

SEQ ID NO: 1231 - DNA, 130 bp, Artificial Sequence
  Synthetic
cacatgattacgccaagctttgttgatacaaccataagttgatattttcaaccatatattgatatctctcacaaccataaaatgataattactcttcatggtctaaacttggatcccatgacatatcagg

SEQ ID NO: 1232 - DNA, 130 bp, Artificial Sequence
  Synthetic
cacatgattacgccaagctttgttgatacaaccatatattgatatctccaaccatatattgatatctctcacaaccataaaatgataattactcttcatggtctaaacttggatcccatgacatatcagg

SEQ ID NO: 1233 - DNA, 130 bp, Artificial Sequence
  Synthetic
cacatgattacgccaagctttgttgatacaaccataaagtgatatttacaaccatatattgatatctctcacaaccataaaatgataattactcttcatggtctaaacttggatcccatgacatatcagg

SEQ ID NO: 1234 - DNA, 130 bp, Artificial Sequence
  Synthetic
cacatgattacgccaagctttgttgatacaaccataaaatgataattacaaccataaagtgatatttatcacaaccataaaatgataattactcttcatggtctaaacttggatcccatgacatatcagg

SEQ ID NO: 1235 - DNA, 130 bp, Artificial Sequence
  Synthetic
cacatgattacgccaagctttgttgatacacccataaattgataattacaaccataaagtgatatttatcacaaccataaaatgataattactcttcatggtctaaacttggatcccatgacatatcagg

SEQ ID NO: 1236 - DNA, 130 bp, Artificial Sequence
  Synthetic
cacatgattacgccaagctttgttgatacacccataaattgatattgccaaccataaagtgatatttatcacaaccataaaatgataattactcttcatggtctaaacttggatcccatgacatatcagg

SEQ ID NO: 1237 - DNA, 130 bp, Artificial Sequence
  Synthetic
cacatgattacgccaagctttgttgatagtctaaacttcagtaagtttacgaccaaccataaagtgatatttatcacaaccataaaatgataattactcttcatggtctaggatcccatgacatatcagg

SEQ ID NO: 1238 - DNA, 130 bp, Artificial Sequence
  Synthetic
cacatgattacgccaagctttgttgatacaaccataagttgatattttcaaccataaagtgatatttatcacaaccataaaatgataattactcttcatggtctaaacttggatcccatgacatatcagg

SEQ ID NO: 1239 - DNA, 130 bp, Artificial Sequence
  Synthetic
cacatgattacgccaagctttgttgatacaaccatatattgatatctccaaccataaagtgatatttatcacaaccataaaatgataattactcttcatggtctaaacttggatcccatgacatatcagg

SEQ ID NO: 1240 - DNA, 130 bp, Artificial Sequence
  Synthetic
cacatgattacgccaagctttgttgatacaaccataaagtgatatttacaaccataaagtgatatttatcacaaccataaaatgataattactcttcatggtctaaacttggatcccatgacatatcagg

SEQ ID NO: 1241 - DNA, 130 bp, Artificial Sequence
  Synthetic
cacatgattacgccaagctttgttgatacaaccataaaatgataattacaaccataaaatgataattatcacaaccataaaatgataattactcttcatggtctaaacttggatcccatgacatatcagg

SEQ ID NO: 1242 - DNA, 130 bp, Artificial Sequence
  Synthetic
cacatgattacgccaagctttgttgatacacccataaattgataattacaaccataaaatgataattatcacaaccataaaatgataattactcttcatggtctaaacttggatcccatgacatatcagg

SEQ ID NO: 1243 - DNA, 130 bp, Artificial Sequence
  Synthetic
cacatgattacgccaagctttgttgatacacccataaattgatattgccaaccataaaatgataattatcacaaccataaaatgataattactcttcatggtctaaacttggatcccatgacatatcagg

SEQ ID NO: 1244 - DNA, 130 bp, Artificial Sequence
  Synthetic
cacatgattacgccaagctttgttgatagtctaaacttcagtaagtttacgaccaaccataaaatgataattatcacaaccataaaatgataattactcttcatggtctaggatcccatgacatatcagg

SEQ ID NO: 1245 - DNA, 130 bp, Artificial Sequence
  Synthetic
cacatgattacgccaagctttgttgatacaaccataagttgatattttcaaccataaaatgataattatcacaaccataaaatgataattactcttcatggtctaaacttggatcccatgacatatcagg

SEQ ID NO: 1246 - DNA, 130 bp, Artificial Sequence
  Synthetic
cacatgattacgccaagctttgttgatacaaccatatattgatatctccaaccataaaatgataattatcacaaccataaaatgataattactcttcatggtctaaacttggatcccatgacatatcagg

SEQ ID NO: 1247 - DNA, 130 bp, Artificial Sequence
  Synthetic
cacatgattacgccaagctttgttgatacaaccataaagtgatatttacaaccataaaatgataattatcacaaccataaaatgataattactcttcatggtctaaacttggatcccatgacatatcagg

SEQ ID NO: 1248 - DNA, 130 bp, Artificial Sequence
  Synthetic
cacatgattacgccaagctttgttgatacaaccataaaatgataattacacccataaattgataattatcacacccataaattgataattactcttcatggtctaaacttggatcccatgacatatcagg

SEQ ID NO: 1249 - DNA, 130 bp, Artificial Sequence
  Synthetic
cacatgattacgccaagctttgttgatacacccataaattgataattacacccataaattgataattatcacacccataaattgataattactcttcatggtctaaacttggatcccatgacatatcagg

SEQ ID NO: 1250 - DNA, 130 bp, Artificial Sequence
  Synthetic
cacatgattacgccaagctttgttgatacacccataaattgatattgccacccataaattgataattatcacacccataaattgataattactcttcatggtctaaacttggatcccatgacatatcagg

SEQ ID NO: 1251 - DNA, 130 bp, Artificial Sequence
  Synthetic
cacatgattacgccaagctttgttgatagtctaaacttcagtaagtttacgaccacccataaattgataattatcacacccataaattgataattactcttcatggtctaggatcccatgacatatcagg

SEQ ID NO: 1252 - DNA, 130 bp, Artificial Sequence
  Synthetic
cacatgattacgccaagctttgttgatacaaccataagttgatattttcacccataaattgataattatcacacccataaattgataattactcttcatggtctaaacttggatcccatgacatatcagg

SEQ ID NO: 1253 - DNA, 130 bp, Artificial Sequence
  Synthetic
cacatgattacgccaagctttgttgatacaaccatatattgatatctccacccataaattgataattatcacacccataaattgataattactcttcatggtctaaacttggatcccatgacatatcagg

SEQ ID NO: 1254 - DNA, 130 bp, Artificial Sequence
  Synthetic
cacatgattacgccaagctttgttgatacaaccataaagtgatatttacacccataaattgataattatcacacccataaattgataattactcttcatggtctaaacttggatcccatgacatatcagg

SEQ ID NO: 1255 - DNA, 130 bp, Artificial Sequence
  Synthetic
cacatgattacgccaagctttgttgatacaaccataaaatgataattacacccataaattgatattgctcacacccataaattgataattactcttcatggtctaaacttggatcccatgacatatcagg

SEQ ID NO: 1256 - DNA, 130 bp, Artificial Sequence
  Synthetic
cacatgattacgccaagctttgttgatacacccataaattgataattacacccataaattgatattgctcacacccataaattgataattactcttcatggtctaaacttggatcccatgacatatcagg

SEQ ID NO: 1257 - DNA, 130 bp, Artificial Sequence
  Synthetic
cacatgattacgccaagctttgttgatacacccataaattgatattgccacccataaattgatattgctcacacccataaattgataattactcttcatggtctaaacttggatcccatgacatatcagg

SEQ ID NO: 1258 - DNA, 130 bp, Artificial Sequence
  Synthetic
cacatgattacgccaagctttgttgatagtctaaacttcagtaagtttacgaccacccataaattgatattgctcacacccataaattgataattactcttcatggtctaggatcccatgacatatcagg

SEQ ID NO: 1259 - DNA, 130 bp, Artificial Sequence
  Synthetic
cacatgattacgccaagctttgttgatacaaccataagttgatattttcacccataaattgatattgctcacacccataaattgataattactcttcatggtctaaacttggatcccatgacatatcagg

SEQ ID NO: 1260 - DNA, 130 bp, Artificial Sequence
  Synthetic
cacatgattacgccaagctttgttgatacaaccatatattgatatctccacccataaattgatattgctcacacccataaattgataattactcttcatggtctaaacttggatcccatgacatatcagg

SEQ ID NO: 1261 - DNA, 130 bp, Artificial Sequence
  Synthetic
cacatgattacgccaagctttgttgatacaaccataaagtgatatttacacccataaattgatattgctcacacccataaattgataattactcttcatggtctaaacttggatcccatgacatatcagg

SEQ ID NO: 1262 - DNA, 130 bp, Artificial Sequence
  Synthetic
cacatgattacgccaagctttgttgatacaaccataaaatgataattagtctaaacttcagtaagtttacgactcacacccataaattgataattactcttcatggtctaggatcccatgacatatcagg

SEQ ID NO: 1263 - DNA, 130 bp, Artificial Sequence
  Synthetic
cacatgattacgccaagctttgttgatacacccataaattgataattagtctaaacttcagtaagtttacgactcacacccataaattgataattactcttcatggtctaggatcccatgacatatcagg

SEQ ID NO: 1264 - DNA, 130 bp, Artificial Sequence
  Synthetic
cacatgattacgccaagctttgttgatacacccataaattgatattgcgtctaaacttcagtaagtttacgactcacacccataaattgataattactcttcatggtctaggatcccatgacatatcagg

SEQ ID NO: 1265 - DNA, 130 bp, Artificial Sequence
  Synthetic
cacatgattacgccaagctttgttgatagtctaaacttcagtaagtttacgacgtctaaacttcagtaagtttacgactcacacccataaattgataattactcttcatgggatcccatgacatatcagg

SEQ ID NO: 1266 - DNA, 130 bp, Artificial Sequence
  Synthetic
cacatgattacgccaagctttgttgatacaaccataagttgatattttgtctaaacttcagtaagtttacgactcacacccataaattgataattactcttcatggtctaggatcccatgacatatcagg

SEQ ID NO: 1267 - DNA, 130 bp, Artificial Sequence
  Synthetic
cacatgattacgccaagctttgttgatacaaccatatattgatatctcgtctaaacttcagtaagtttacgactcacacccataaattgataattactcttcatggtctaggatcccatgacatatcagg

SEQ ID NO: 1268 - DNA, 130 bp, Artificial Sequence
  Synthetic
cacatgattacgccaagctttgttgatacaaccataaagtgatatttagtctaaacttcagtaagtttacgactcacacccataaattgataattactcttcatggtctaggatcccatgacatatcagg

SEQ ID NO: 1269 - DNA, 130 bp, Artificial Sequence
  Synthetic
cacatgattacgccaagctttgttgatacaaccataaaatgataattacaaccataagttgatatttttcacacccataaattgataattactcttcatggtctaaacttggatcccatgacatatcagg

SEQ ID NO: 1270 - DNA, 130 bp, Artificial Sequence
  Synthetic
cacatgattacgccaagctttgttgatacacccataaattgataattacaaccataagttgatatttttcacacccataaattgataattactcttcatggtctaaacttggatcccatgacatatcagg

SEQ ID NO: 1271 - DNA, 130 bp, Artificial Sequence
  Synthetic
cacatgattacgccaagctttgttgatacacccataaattgatattgccaaccataagttgatatttttcacacccataaattgataattactcttcatggtctaaacttggatcccatgacatatcagg

SEQ ID NO: 1272 - DNA, 130 bp, Artificial Sequence
  Synthetic
cacatgattacgccaagctttgttgatagtctaaacttcagtaagtttacgaccaaccataagttgatatttttcacacccataaattgataattactcttcatggtctaggatcccatgacatatcagg

SEQ ID NO: 1273 - DNA, 130 bp, Artificial Sequence
  Synthetic
cacatgattacgccaagctttgttgatacaaccataagttgatattttcaaccataagttgatatttttcacacccataaattgataattactcttcatggtctaaacttggatcccatgacatatcagg

SEQ ID NO: 1274 - DNA, 130 bp, Artificial Sequence
  Synthetic
cacatgattacgccaagctttgttgatacaaccatatattgatatctccaaccataagttgatatttttcacacccataaattgataattactcttcatggtctaaacttggatcccatgacatatcagg

SEQ ID NO: 1275 - DNA, 130 bp, Artificial Sequence
  Synthetic
cacatgattacgccaagctttgttgatacaaccataaagtgatatttacaaccataagttgatatttttcacacccataaattgataattactcttcatggtctaaacttggatcccatgacatatcagg

SEQ ID NO: 1276 - DNA, 130 bp, Artificial Sequence
  Synthetic
cacatgattacgccaagctttgttgatacaaccataaaatgataattacaaccatatattgatatctctcacacccataaattgataattactcttcatggtctaaacttggatcccatgacatatcagg

SEQ ID NO: 1277 - DNA, 130 bp, Artificial Sequence
  Synthetic
cacatgattacgccaagctttgttgatacacccataaattgataattacaaccatatattgatatctctcacacccataaattgataattactcttcatggtctaaacttggatcccatgacatatcagg

SEQ ID NO: 1278 - DNA, 130 bp, Artificial Sequence
  Synthetic
cacatgattacgccaagctttgttgatacacccataaattgatattgccaaccatatattgatatctctcacacccataaattgataattactcttcatggtctaaacttggatcccatgacatatcagg

SEQ ID NO: 1279 - DNA, 130 bp, Artificial Sequence
  Synthetic
cacatgattacgccaagctttgttgatagtctaaacttcagtaagtttacgaccaaccatatattgatatctctcacacccataaattgataattactcttcatggtctaggatcccatgacatatcagg

SEQ ID NO: 1280 - DNA, 130 bp, Artificial Sequence
  Synthetic
cacatgattacgccaagctttgttgatacaaccataagttgatattttcaaccatatattgatatctctcacacccataaattgataattactcttcatggtctaaacttggatcccatgacatatcagg

SEQ ID NO: 1281 - DNA, 130 bp, Artificial Sequence
  Synthetic
cacatgattacgccaagctttgttgatacaaccatatattgatatctccaaccatatattgatatctctcacacccataaattgataattactcttcatggtctaaacttggatcccatgacatatcagg

SEQ ID NO: 1282 - DNA, 130 bp, Artificial Sequence
  Synthetic
cacatgattacgccaagctttgttgatacaaccataaagtgatatttacaaccatatattgatatctctcacacccataaattgataattactcttcatggtctaaacttggatcccatgacatatcagg

SEQ ID NO: 1283 - DNA, 130 bp, Artificial Sequence
  Synthetic
cacatgattacgccaagctttgttgatacaaccataaaatgataattacaaccataaagtgatatttatcacacccataaattgataattactcttcatggtctaaacttggatcccatgacatatcagg

SEQ ID NO: 1284 - DNA, 130 bp, Artificial Sequence
  Synthetic
cacatgattacgccaagctttgttgatacacccataaattgataattacaaccataaagtgatatttatcacacccataaattgataattactcttcatggtctaaacttggatcccatgacatatcagg

SEQ ID NO: 1285 - DNA, 130 bp, Artificial Sequence
  Synthetic
cacatgattacgccaagctttgttgatacacccataaattgatattgccaaccataaagtgatatttatcacacccataaattgataattactcttcatggtctaaacttggatcccatgacatatcagg

SEQ ID NO: 1286 - DNA, 130 bp, Artificial Sequence
  Synthetic
cacatgattacgccaagctttgttgatagtctaaacttcagtaagtttacgaccaaccataaagtgatatttatcacacccataaattgataattactcttcatggtctaggatcccatgacatatcagg

SEQ ID NO: 1287 - DNA, 130 bp, Artificial Sequence
  Synthetic
cacatgattacgccaagctttgttgatacaaccataagttgatattttcaaccataaagtgatatttatcacacccataaattgataattactcttcatggtctaaacttggatcccatgacatatcagg

SEQ ID NO: 1288 - DNA, 130 bp, Artificial Sequence
  Synthetic
cacatgattacgccaagctttgttgatacaaccatatattgatatctccaaccataaagtgatatttatcacacccataaattgataattactcttcatggtctaaacttggatcccatgacatatcagg

SEQ ID NO: 1289 - DNA, 130 bp, Artificial Sequence
  Synthetic
cacatgattacgccaagctttgttgatacaaccataaagtgatatttacaaccataaagtgatatttatcacacccataaattgataattactcttcatggtctaaacttggatcccatgacatatcagg

SEQ ID NO: 1290 - DNA, 130 bp, Artificial Sequence
  Synthetic
cacatgattacgccaagctttgttgatacaaccataaaatgataattacaaccataaaatgataattatcacacccataaattgataattactcttcatggtctaaacttggatcccatgacatatcagg

SEQ ID NO: 1291 - DNA, 130 bp, Artificial Sequence
  Synthetic
cacatgattacgccaagctttgttgatacacccataaattgataattacaaccataaaatgataattatcacacccataaattgataattactcttcatggtctaaacttggatcccatgacatatcagg

SEQ ID NO: 1292 - DNA, 130 bp, Artificial Sequence
  Synthetic
cacatgattacgccaagctttgttgatacacccataaattgatattgccaaccataaaatgataattatcacacccataaattgataattactcttcatggtctaaacttggatcccatgacatatcagg

SEQ ID NO: 1293 - DNA, 130 bp, Artificial Sequence
  Synthetic
cacatgattacgccaagctttgttgatagtctaaacttcagtaagtttacgaccaaccataaaatgataattatcacacccataaattgataattactcttcatggtctaggatcccatgacatatcagg

SEQ ID NO: 1294 - DNA, 130 bp, Artificial Sequence
  Synthetic
cacatgattacgccaagctttgttgatacaaccataagttgatattttcaaccataaaatgataattatcacacccataaattgataattactcttcatggtctaaacttggatcccatgacatatcagg

SEQ ID NO: 1295 - DNA, 130 bp, Artificial Sequence
  Synthetic
cacatgattacgccaagctttgttgatacaaccatatattgatatctccaaccataaaatgataattatcacacccataaattgataattactcttcatggtctaaacttggatcccatgacatatcagg

SEQ ID NO: 1296 - DNA, 130 bp, Artificial Sequence
  Synthetic
cacatgattacgccaagctttgttgatacaaccataaagtgatatttacaaccataaaatgataattatcacacccataaattgataattactcttcatggtctaaacttggatcccatgacatatcagg

SEQ ID NO: 1297 - DNA, 130 bp, Artificial Sequence
  Synthetic
gttctgctgtagtcaagctttgttgatacaaccataaaatgataattacacccataaattgataattatcagtgggtatttaactataacgctcttcatggtctaaacttggatcctccatctgagtgag

SEQ ID NO: 1298 - DNA, 130 bp, Artificial Sequence
  Synthetic
gttctgctgtagtcaagctttgttgatacacccataaattgataattacacccataaattgataattatcagtgggtatttaactataacgctcttcatggtctaaacttggatcctccatctgagtgag

SEQ ID NO: 1299 - DNA, 130 bp, Artificial Sequence
  Synthetic
gttctgctgtagtcaagctttgttgatacacccataaattgatattgccacccataaattgataattatcagtgggtatttaactataacgctcttcatggtctaaacttggatcctccatctgagtgag

SEQ ID NO: 1300 - DNA, 130 bp, Artificial Sequence
  Synthetic
gttctgctgtagtcaagctttgttgatagtctaaacttcagtaagtttacgaccacccataaattgataattatcagtgggtatttaactataacgctcttcatggtctaggatcctccatctgagtgag

SEQ ID NO: 1301 - DNA, 130 bp, Artificial Sequence
  Synthetic
gttctgctgtagtcaagctttgttgatacaaccataagttgatattttcacccataaattgataattatcagtgggtatttaactataacgctcttcatggtctaaacttggatcctccatctgagtgag

SEQ ID NO: 1302 - DNA, 130 bp, Artificial Sequence
  Synthetic
gttctgctgtagtcaagctttgttgatacaaccatatattgatatctccacccataaattgataattatcagtgggtatttaactataacgctcttcatggtctaaacttggatcctccatctgagtgag

SEQ ID NO: 1303 - DNA, 130 bp, Artificial Sequence
  Synthetic
gttctgctgtagtcaagctttgttgatacaaccataaagtgatatttacacccataaattgataattatcagtgggtatttaactataacgctcttcatggtctaaacttggatcctccatctgagtgag

SEQ ID NO: 1304 - DNA, 130 bp, Artificial Sequence
  Synthetic
gttctgctgtagtcaagctttgttgatacaaccataaaatgataattacacccataaattgatattgctcagtgggtatttaactataacgctcttcatggtctaaacttggatcctccatctgagtgag

SEQ ID NO: 1305 - DNA, 130 bp, Artificial Sequence
  Synthetic
gttctgctgtagtcaagctttgttgatacacccataaattgataattacacccataaattgatattgctcagtgggtatttaactataacgctcttcatggtctaaacttggatcctccatctgagtgag

SEQ ID NO: 1306 - DNA, 130 bp, Artificial Sequence
  Synthetic
gttctgctgtagtcaagctttgttgatacacccataaattgatattgccacccataaattgatattgctcagtgggtatttaactataacgctcttcatggtctaaacttggatcctccatctgagtgag

SEQ ID NO: 1307 - DNA, 130 bp, Artificial Sequence
  Synthetic
gttctgctgtagtcaagctttgttgatagtctaaacttcagtaagtttacgaccacccataaattgatattgctcagtgggtatttaactataacgctcttcatggtctaggatcctccatctgagtgag

SEQ ID NO: 1308 - DNA, 130 bp, Artificial Sequence
  Synthetic
gttctgctgtagtcaagctttgttgatacaaccataagttgatattttcacccataaattgatattgctcagtgggtatttaactataacgctcttcatggtctaaacttggatcctccatctgagtgag

SEQ ID NO: 1309 - DNA, 130 bp, Artificial Sequence
  Synthetic
gttctgctgtagtcaagctttgttgatacaaccatatattgatatctccacccataaattgatattgctcagtgggtatttaactataacgctcttcatggtctaaacttggatcctccatctgagtgag

SEQ ID NO: 1310 - DNA, 130 bp, Artificial Sequence
  Synthetic
gttctgctgtagtcaagctttgttgatacaaccataaagtgatatttacacccataaattgatattgctcagtgggtatttaactataacgctcttcatggtctaaacttggatcctccatctgagtgag

SEQ ID NO: 1311 - DNA, 130 bp, Artificial Sequence
  Synthetic
gttctgctgtagtcaagctttgttgatacaaccataaaatgataattagtctaaacttcagtaagtttacgactcagtgggtatttaactataacgctcttcatggtctaggatcctccatctgagtgag

SEQ ID NO: 1312 - DNA, 130 bp, Artificial Sequence
  Synthetic
gttctgctgtagtcaagctttgttgatacacccataaattgataattagtctaaacttcagtaagtttacgactcagtgggtatttaactataacgctcttcatggtctaggatcctccatctgagtgag

SEQ ID NO: 1313 - DNA, 130 bp, Artificial Sequence
  Synthetic
gttctgctgtagtcaagctttgttgatacacccataaattgatattgcgtctaaacttcagtaagtttacgactcagtgggtatttaactataacgctcttcatggtctaggatcctccatctgagtgag

SEQ ID NO: 1314 - DNA, 130 bp, Artificial Sequence
  Synthetic
gttctgctgtagtcaagctttgttgatagtctaaacttcagtaagtttacgacgtctaaacttcagtaagtttacgactcagtgggtatttaactataacgctcttcatgggatcctccatctgagtgag

SEQ ID NO: 1315 - DNA, 130 bp, Artificial Sequence
  Synthetic
gttctgctgtagtcaagctttgttgatacaaccataagttgatattttgtctaaacttcagtaagtttacgactcagtgggtatttaactataacgctcttcatggtctaggatcctccatctgagtgag

SEQ ID NO: 1316 - DNA, 130 bp, Artificial Sequence
  Synthetic
gttctgctgtagtcaagctttgttgatacaaccatatattgatatctcgtctaaacttcagtaagtttacgactcagtgggtatttaactataacgctcttcatggtctaggatcctccatctgagtgag

SEQ ID NO: 1317 - DNA, 130 bp, Artificial Sequence
  Synthetic
gttctgctgtagtcaagctttgttgatacaaccataaagtgatatttagtctaaacttcagtaagtttacgactcagtgggtatttaactataacgctcttcatggtctaggatcctccatctgagtgag

SEQ ID NO: 1318 - DNA, 130 bp, Artificial Sequence
  Synthetic
gttctgctgtagtcaagctttgttgatacaaccataaaatgataattacaaccataagttgatatttttcagtgggtatttaactataacgctcttcatggtctaaacttggatcctccatctgagtgag

SEQ ID NO: 1319 - DNA, 130 bp, Artificial Sequence
  Synthetic
gttctgctgtagtcaagctttgttgatacacccataaattgataattacaaccataagttgatatttttcagtgggtatttaactataacgctcttcatggtctaaacttggatcctccatctgagtgag

SEQ ID NO: 1320 - DNA, 130 bp, Artificial Sequence
  Synthetic
gttctgctgtagtcaagctttgttgatacacccataaattgatattgccaaccataagttgatatttttcagtgggtatttaactataacgctcttcatggtctaaacttggatcctccatctgagtgag

SEQ ID NO: 1321 - DNA, 130 bp, Artificial Sequence
  Synthetic
gttctgctgtagtcaagctttgttgatagtctaaacttcagtaagtttacgaccaaccataagttgatatttttcagtgggtatttaactataacgctcttcatggtctaggatcctccatctgagtgag

SEQ ID NO: 1322 - DNA, 130 bp, Artificial Sequence
  Synthetic
gttctgctgtagtcaagctttgttgatacaaccataagttgatattttcaaccataagttgatatttttcagtgggtatttaactataacgctcttcatggtctaaacttggatcctccatctgagtgag

SEQ ID NO: 1323 - DNA, 130 bp, Artificial Sequence
  Synthetic
gttctgctgtagtcaagctttgttgatacaaccatatattgatatctccaaccataagttgatatttttcagtgggtatttaactataacgctcttcatggtctaaacttggatcctccatctgagtgag

SEQ ID NO: 1324 - DNA, 130 bp, Artificial Sequence
  Synthetic
gttctgctgtagtcaagctttgttgatacaaccataaagtgatatttacaaccataagttgatatttttcagtgggtatttaactataacgctcttcatggtctaaacttggatcctccatctgagtgag

SEQ ID NO: 1325 - DNA, 130 bp, Artificial Sequence
  Synthetic
gttctgctgtagtcaagctttgttgatacaaccataaaatgataattacaaccatatattgatatctctcagtgggtatttaactataacgctcttcatggtctaaacttggatcctccatctgagtgag

SEQ ID NO: 1326 - DNA, 130 bp, Artificial Sequence
  Synthetic
gttctgctgtagtcaagctttgttgatacacccataaattgataattacaaccatatattgatatctctcagtgggtatttaactataacgctcttcatggtctaaacttggatcctccatctgagtgag

SEQ ID NO: 1327 - DNA, 130 bp, Artificial Sequence
  Synthetic
gttctgctgtagtcaagctttgttgatacacccataaattgatattgccaaccatatattgatatctctcagtgggtatttaactataacgctcttcatggtctaaacttggatcctccatctgagtgag

SEQ ID NO: 1328 - DNA, 130 bp, Artificial Sequence
  Synthetic
gttctgctgtagtcaagctttgttgatagtctaaacttcagtaagtttacgaccaaccatatattgatatctctcagtgggtatttaactataacgctcttcatggtctaggatcctccatctgagtgag

SEQ ID NO: 1329 - DNA, 130 bp, Artificial Sequence
  Synthetic
gttctgctgtagtcaagctttgttgatacaaccataagttgatattttcaaccatatattgatatctctcagtgggtatttaactataacgctcttcatggtctaaacttggatcctccatctgagtgag

SEQ ID NO: 1330 - DNA, 130 bp, Artificial Sequence
  Synthetic
gttctgctgtagtcaagctttgttgatacaaccatatattgatatctccaaccatatattgatatctctcagtgggtatttaactataacgctcttcatggtctaaacttggatcctccatctgagtgag

SEQ ID NO: 1331 - DNA, 130 bp, Artificial Sequence
  Synthetic
gttctgctgtagtcaagctttgttgatacaaccataaagtgatatttacaaccatatattgatatctctcagtgggtatttaactataacgctcttcatggtctaaacttggatcctccatctgagtgag

SEQ ID NO: 1332 - DNA, 130 bp, Artificial Sequence
  Synthetic
gttctgctgtagtcaagctttgttgatacaaccataaaatgataattacaaccataaagtgatatttatcagtgggtatttaactataacgctcttcatggtctaaacttggatcctccatctgagtgag

SEQ ID NO: 1333 - DNA, 130 bp, Artificial Sequence
  Synthetic
gttctgctgtagtcaagctttgttgatacacccataaattgataattacaaccataaagtgatatttatcagtgggtatttaactataacgctcttcatggtctaaacttggatcctccatctgagtgag

SEQ ID NO: 1334 - DNA, 130 bp, Artificial Sequence
  Synthetic
gttctgctgtagtcaagctttgttgatacacccataaattgatattgccaaccataaagtgatatttatcagtgggtatttaactataacgctcttcatggtctaaacttggatcctccatctgagtgag

SEQ ID NO: 1335 - DNA, 130 bp, Artificial Sequence
  Synthetic
gttctgctgtagtcaagctttgttgatagtctaaacttcagtaagtttacgaccaaccataaagtgatatttatcagtgggtatttaactataacgctcttcatggtctaggatcctccatctgagtgag

SEQ ID NO: 1336 - DNA, 130 bp, Artificial Sequence
  Synthetic
gttctgctgtagtcaagctttgttgatacaaccataagttgatattttcaaccataaagtgatatttatcagtgggtatttaactataacgctcttcatggtctaaacttggatcctccatctgagtgag

SEQ ID NO: 1337 - DNA, 130 bp, Artificial Sequence
  Synthetic
gttctgctgtagtcaagctttgttgatacaaccatatattgatatctccaaccataaagtgatatttatcagtgggtatttaactataacgctcttcatggtctaaacttggatcctccatctgagtgag

SEQ ID NO: 1338 - DNA, 130 bp, Artificial Sequence
  Synthetic
gttctgctgtagtcaagctttgttgatacaaccataaagtgatatttacaaccataaagtgatatttatcagtgggtatttaactataacgctcttcatggtctaaacttggatcctccatctgagtgag

SEQ ID NO: 1339 - DNA, 130 bp, Artificial Sequence
  Synthetic
gttctgctgtagtcaagctttgttgatacaaccataaaatgataattacaaccataaaatgataattatcagtgggtatttaactataacgctcttcatggtctaaacttggatcctccatctgagtgag

SEQ ID NO: 1340 - DNA, 130 bp, Artificial Sequence
  Synthetic
gttctgctgtagtcaagctttgttgatacacccataaattgataattacaaccataaaatgataattatcagtgggtatttaactataacgctcttcatggtctaaacttggatcctccatctgagtgag

SEQ ID NO: 1341 - DNA, 130 bp, Artificial Sequence
  Synthetic
gttctgctgtagtcaagctttgttgatacacccataaattgatattgccaaccataaaatgataattatcagtgggtatttaactataacgctcttcatggtctaaacttggatcctccatctgagtgag

SEQ ID NO: 1342 - DNA, 130 bp, Artificial Sequence
  Synthetic
gttctgctgtagtcaagctttgttgatagtctaaacttcagtaagtttacgaccaaccataaaatgataattatcagtgggtatttaactataacgctcttcatggtctaggatcctccatctgagtgag

SEQ ID NO: 1343 - DNA, 130 bp, Artificial Sequence
  Synthetic
gttctgctgtagtcaagctttgttgatacaaccataagttgatattttcaaccataaaatgataattatcagtgggtatttaactataacgctcttcatggtctaaacttggatcctccatctgagtgag

SEQ ID NO: 1344 - DNA, 130 bp, Artificial Sequence
  Synthetic
gttctgctgtagtcaagctttgttgatacaaccatatattgatatctccaaccataaaatgataattatcagtgggtatttaactataacgctcttcatggtctaaacttggatcctccatctgagtgag

SEQ ID NO: 1345 - DNA, 130 bp, Artificial Sequence
  Synthetic
gttctgctgtagtcaagctttgttgatacaaccataaagtgatatttacaaccataaaatgataattatcagtgggtatttaactataacgctcttcatggtctaaacttggatcctccatctgagtgag

SEQ ID NO: 1346 - DNA, 130 bp, Artificial Sequence
  Synthetic
gctaccgtgatacaaagctttgttgatacaaccataaaatgataattacacccataaattgataattatcacacccataaattgatattggctcttcatggtctaaacttggatcctgtgtcacgtatcg

SEQ ID NO: 1347 - DNA, 130 bp, Artificial Sequence
  Synthetic
gctaccgtgatacaaagctttgttgatacaaccataaaatgataattacacccataaattgataattatcacacccataaattgatataccctcttcatggtctaaacttggatcctgtgtcacgtatcg

SEQ ID NO: 1348 - DNA, 130 bp, Artificial Sequence
  Synthetic
gctaccgtgatacaaagctttgttgatacaaccataaaatgataattacacccataaattgataattatcacacccataaattgattatgcctcttcatggtctaaacttggatcctgtgtcacgtatcg

SEQ ID NO: 1349 - DNA, 130 bp, Artificial Sequence
  Synthetic
gctaccgtgatacaaagctttgttgatacaaccataaaatgataattacacccataaattgataattatcacacccataaattgtaattgcctcttcatggtctaaacttggatcctgtgtcacgtatcg

SEQ ID NO: 1350 - DNA, 130 bp, Artificial Sequence
  Synthetic
gctaccgtgatacaaagctttgttgatacaaccataaaatgataattacacccataaattgataattatcacacccataaatacatattgcctcttcatggtctaaacttggatcctgtgtcacgtatcg

SEQ ID NO: 1351 - DNA, 130 bp, Artificial Sequence
  Synthetic
gctaccgtgatacaaagctttgttgatacaaccataaaatgataattacacccataaattgataattatcacacccataatatgatattgcctcttcatggtctaaacttggatcctgtgtcacgtatcg

SEQ ID NO: 1352 - DNA, 130 bp, Artificial Sequence
  Synthetic
gctaccgtgatacaaagctttgttgatacaaccataaaatgataattacacccataaattgataattatcacacccatttattgatattgcctcttcatggtctaaacttggatcctgtgtcacgtatcg

SEQ ID NO: 1353 - DNA, 130 bp, Artificial Sequence
  Synthetic
gctaccgtgatacaaagctttgttgatacaaccataaaatgataattacacccataaattgataattatcacaccctaaaattgatattgcctcttcatggtctaaacttggatcctgtgtcacgtatcg

SEQ ID NO: 1354 - DNA, 130 bp, Artificial Sequence
  Synthetic
gctaccgtgatacaaagctttgttgatacaaccataaaatgataattacacccataaattgataattatcacacggataaattgatattgcctcttcatggtctaaacttggatcctgtgtcacgtatcg

SEQ ID NO: 1355 - DNA, 130 bp, Artificial Sequence
  Synthetic
gctaccgtgatacaaagctttgttgatacaaccataaaatgataattacacccataaattgataattatcactgccataaattgatattgcctcttcatggtctaaacttggatcctgtgtcacgtatcg

SEQ ID NO: 1356 - DNA, 130 bp, Artificial Sequence
  Synthetic
gctaccgtgatacaaagctttgttgatacaaccataaaatgataattacacccataaattgataattatctgacccataaattgatattgcctcttcatggtctaaacttggatcctgtgtcacgtatcg

SEQ ID NO: 1357 - DNA, 130 bp, Artificial Sequence
  Synthetic
gctaccgtgatacaaagctttgttgatacaaccataaaatgataattacacccataaattgataattaagacacccataaattgatattgcctcttcatggtctaaacttggatcctgtgtcacgtatcg

SEQ ID NO: 1358 - DNA, 130 bp, Artificial Sequence
  Synthetic
gctaccgtgatacaaagctttgttgatacaaccataaaatgataattacacccataaattgataatattcacacccataaattgatattgcctcttcatggtctaaacttggatcctgtgtcacgtatcg

SEQ ID NO: 1359 - DNA, 130 bp, Artificial Sequence
  Synthetic
gctaccgtgatacaaagctttgttgatacaaccataaaatgataattacacccataaattgatatatatcacacccataaattgatattgcctcttcatggtctaaacttggatcctgtgtcacgtatcg

SEQ ID NO: 1360 - DNA, 130 bp, Artificial Sequence
  Synthetic
gctaccgtgatacaaagctttgttgatacaaccataaaatgataattacacccataaattgaatattatcacacccataaattgatattgcctcttcatggtctaaacttggatcctgtgtcacgtatcg

SEQ ID NO: 1361 - DNA, 130 bp, Artificial Sequence
  Synthetic
gctaccgtgatacaaagctttgttgatacaaccataaaatgataattacacccataaattcttaattatcacacccataaattgatattgcctcttcatggtctaaacttggatcctgtgtcacgtatcg

SEQ ID NO: 1362 - DNA, 130 bp, Artificial Sequence
  Synthetic
gctaccgtgatacaaagctttgttgatacaaccataaaatgataattacacccataaaaagataattatcacacccataaattgatattgcctcttcatggtctaaacttggatcctgtgtcacgtatcg

SEQ ID NO: 1363 - DNA, 130 bp, Artificial Sequence
  Synthetic
gctaccgtgatacaaagctttgttgatacaaccataaaatgataattacacccatattttgataattatcacacccataaattgatattgcctcttcatggtctaaacttggatcctgtgtcacgtatcg

SEQ ID NO: 1364 - DNA, 130 bp, Artificial Sequence
  Synthetic
gctaccgtgatacaaagctttgttgatacaaccataaaatgataattacacccaataattgataattatcacacccataaattgatattgcctcttcatggtctaaacttggatcctgtgtcacgtatcg

SEQ ID NO: 1365 - DNA, 130 bp, Artificial Sequence
  Synthetic
gctaccgtgatacaaagctttgttgatacaaccataaaatgataattacaccgttaaattgataattatcacacccataaattgatattgcctcttcatggtctaaacttggatcctgtgtcacgtatcg

SEQ ID NO: 1366 - DNA, 130 bp, Artificial Sequence
  Synthetic
gctaccgtgatacaaagctttgttgatacaaccataaaatgataattacaggcataaattgataattatcacacccataaattgatattgcctcttcatggtctaaacttggatcctgtgtcacgtatcg

SEQ ID NO: 1367 - DNA, 130 bp, Artificial Sequence
  Synthetic
gctaccgtgatacaaagctttgttgatacaaccataaaatgataattagtcccataaattgataattatcacacccataaattgatattgcctcttcatggtctaaacttggatcctgtgtcacgtatcg

SEQ ID NO: 1368 - DNA, 130 bp, Artificial Sequence
  Synthetic
gctaccgtgatacaaagctttgttgatacaaccataaaatgataatatcacccataaattgataattatcacacccataaattgatattgcctcttcatggtctaaacttggatcctgtgtcacgtatcg

SEQ ID NO: 1369 - DNA, 130 bp, Artificial Sequence
  Synthetic
gctaccgtgatacaaagctttgttgatacaaccataaaatgatatatacacccataaattgataattatcacacccataaattgatattgcctcttcatggtctaaacttggatcctgtgtcacgtatcg

SEQ ID NO: 1370 - DNA, 130 bp, Artificial Sequence
  Synthetic
gctaccgtgatacaaagctttgttgatacaaccataaaatgaatattacacccataaattgataattatcacacccataaattgatattgcctcttcatggtctaaacttggatcctgtgtcacgtatcg

SEQ ID NO: 1371 - DNA, 130 bp, Artificial Sequence
  Synthetic
gctaccgtgatacaaagctttgttgatacaaccataaaatcttaattacacccataaattgataattatcacacccataaattgatattgcctcttcatggtctaaacttggatcctgtgtcacgtatcg

SEQ ID NO: 1372 - DNA, 130 bp, Artificial Sequence
  Synthetic
gctaccgtgatacaaagctttgttgatacaaccataaatagataattacacccataaattgataattatcacacccataaattgatattgcctcttcatggtctaaacttggatcctgtgtcacgtatcg

SEQ ID NO: 1373 - DNA, 130 bp, Artificial Sequence
  Synthetic
gctaccgtgatacaaagctttgttgatacaaccatattatgataattacacccataaattgataattatcacacccataaattgatattgcctcttcatggtctaaacttggatcctgtgtcacgtatcg

SEQ ID NO: 1374 - DNA, 130 bp, Artificial Sequence
  Synthetic
gctaccgtgatacaaagctttgttgatacaaccaataaatgataattacacccataaattgataattatcacacccataaattgatattgcctcttcatggtctaaacttggatcctgtgtcacgtatcg

SEQ ID NO: 1375 - DNA, 130 bp, Artificial Sequence
  Synthetic
gctaccgtgatacaaagctttgttgatacaacgttaaaatgataattacacccataaattgataattatcacacccataaattgatattgcctcttcatggtctaaacttggatcctgtgtcacgtatcg

SEQ ID NO: 1376 - DNA, 130 bp, Artificial Sequence
  Synthetic
gctaccgtgatacaaagctttgttgatacatgcataaaatgataattacacccataaattgataattatcacacccataaattgatattgcctcttcatggtctaaacttggatcctgtgtcacgtatcg

SEQ ID NO: 1377 - DNA, 130 bp, Artificial Sequence
  Synthetic
gctaccgtgatacaaagctttgttgatagtaccataaaatgataattacacccataaattgataattatcacacccataaattgatattgcctcttcatggtctaaacttggatcctgtgtcacgtatcg

SEQ ID NO: 1378 - DNA, 130 bp, Artificial Sequence
  Synthetic
gctaccgtgatacaaagctttgttgaatcaaccataaaatgataattacacccataaattgataattatcacacccataaattgatattgcctcttcatggtctaaacttggatcctgtgtcacgtatcg

SEQ ID NO: 1379 - DNA, 130 bp, Artificial Sequence
  Synthetic
gctaccgtgatacaaagctttgttcttacaaccataaaatgataattacacccataaattgataattatcacacccataaattgatattgcctcttcatggtctaaacttggatcctgtgtcacgtatcg

SEQ ID NO: 1380 - DNA, 130 bp, Artificial Sequence
  Synthetic
gctaccgtgatacaaagctttgaagatacaaccataaaatgataattacacccataaattgataattatcacacccataaattgatattgcctcttcatggtctaaacttggatcctgtgtcacgtatcg

SEQ ID NO: 1381 - DNA, 130 bp, Artificial Sequence
  Synthetic
gctaccgtgatacaaagcttacttgatacaaccataaaatgataattacacccataaattgataattatcacacccataaattgatattgcctcttcatggtctaaacttggatcctgtgtcacgtatcg

SEQ ID NO: 1382 - DNA, 130 bp, Artificial Sequence
  Synthetic
gctaccgtgatacaaagctttgttgatacaaccataaaatgataattacacccataaattgataattatcacacccataaattgatattgtctcttcatggtctaaacttggatcctgtgtcacgtatcg

SEQ ID NO: 1383 - DNA, 130 bp, Artificial Sequence
  Synthetic
gctaccgtgatacaaagctttgttgatacaaccataaaatgataattacacccataaattgataattatcacacccataaattgatatcacctcttcatggtctaaacttggatcctgtgtcacgtatcg

SEQ ID NO: 1384 - DNA, 130 bp, Artificial Sequence
  Synthetic
gctaccgtgatacaaagctttgttgatacaaccataaaatgataattacacccataaattgataattatcacacccataaattgatgctgcctcttcatggtctaaacttggatcctgtgtcacgtatcg

SEQ ID NO: 1385 - DNA, 130 bp, Artificial Sequence
  Synthetic
gctaccgtgatacaaagctttgttgatacaaccataaaatgataattacacccataaattgataattatcacacccataaattggcattgcctcttcatggtctaaacttggatcctgtgtcacgtatcg

SEQ ID NO: 1386 - DNA, 130 bp, Artificial Sequence
  Synthetic
gctaccgtgatacaaagctttgttgatacaaccataaaatgataattacacccataaattgataattatcacacccataaatcaatattgcctcttcatggtctaaacttggatcctgtgtcacgtatcg

SEQ ID NO: 1387 - DNA, 130 bp, Artificial Sequence
  Synthetic
gctaccgtgatacaaagctttgttgatacaaccataaaatgataattacacccataaattgataattatcacacccataagctgatattgcctcttcatggtctaaacttggatcctgtgtcacgtatcg

SEQ ID NO: 1388 - DNA, 130 bp, Artificial Sequence
  Synthetic
gctaccgtgatacaaagctttgttgatacaaccataaaatgataattacacccataaattgataattatcacacccatggattgatattgcctcttcatggtctaaacttggatcctgtgtcacgtatcg

SEQ ID NO: 1389 - DNA, 130 bp, Artificial Sequence
  Synthetic
gctaccgtgatacaaagctttgttgatacaaccataaaatgataattacacccataaattgataattatcacacccgcaaattgatattgcctcttcatggtctaaacttggatcctgtgtcacgtatcg

SEQ ID NO: 1390 - DNA, 130 bp, Artificial Sequence
  Synthetic
gctaccgtgatacaaagctttgttgatacaaccataaaatgataattacacccataaattgataattatcacacttataaattgatattgcctcttcatggtctaaacttggatcctgtgtcacgtatcg

SEQ ID NO: 1391 - DNA, 130 bp, Artificial Sequence
  Synthetic
gctaccgtgatacaaagctttgttgatacaaccataaaatgataattacacccataaattgataattatcacgtccataaattgatattgcctcttcatggtctaaacttggatcctgtgtcacgtatcg

SEQ ID NO: 1392 - DNA, 130 bp, Artificial Sequence
  Synthetic
gctaccgtgatacaaagctttgttgatacaaccataaaatgataattacacccataaattgataattatcgtacccataaattgatattgcctcttcatggtctaaacttggatcctgtgtcacgtatcg

SEQ ID NO: 1393 - DNA, 130 bp, Artificial Sequence
  Synthetic
gctaccgtgatacaaagctttgttgatacaaccataaaatgataattacacccataaattgataattactacacccataaattgatattgcctcttcatggtctaaacttggatcctgtgtcacgtatcg

SEQ ID NO: 1394 - DNA, 130 bp, Artificial Sequence
  Synthetic
gctaccgtgatacaaagctttgttgatacaaccataaaatgataattacacccataaattgataatcgtcacacccataaattgatattgcctcttcatggtctaaacttggatcctgtgtcacgtatcg

SEQ ID NO: 1395 - DNA, 130 bp, Artificial Sequence
  Synthetic
gctaccgtgatacaaagctttgttgatacaaccataaaatgataattacacccataaattgatagctatcacacccataaattgatattgcctcttcatggtctaaacttggatcctgtgtcacgtatcg

SEQ ID NO: 1396 - DNA, 130 bp, Artificial Sequence
  Synthetic
gctaccgtgatacaaagctttgttgatacaaccataaaatgataattacacccataaattgacgattatcacacccataaattgatattgcctcttcatggtctaaacttggatcctgtgtcacgtatcg

SEQ ID NO: 1397 - DNA, 130 bp, Artificial Sequence
  Synthetic
gctaccgtgatacaaagctttgttgatacaaccataaaatgataattacacccataaattagtaattatcacacccataaattgatattgcctcttcatggtctaaacttggatcctgtgtcacgtatcg

SEQ ID NO: 1398 - DNA, 130 bp, Artificial Sequence
  Synthetic
gctaccgtgatacaaagctttgttgatacaaccataaaatgataattacacccataaaccgataattatcacacccataaattgatattgcctcttcatggtctaaacttggatcctgtgtcacgtatcg

SEQ ID NO: 1399 - DNA, 130 bp, Artificial Sequence
  Synthetic
gctaccgtgatacaaagctttgttgatacaaccataaaatgataattacacccataggttgataattatcacacccataaattgatattgcctcttcatggtctaaacttggatcctgtgtcacgtatcg

SEQ ID NO: 1400 - DNA, 130 bp, Artificial Sequence
  Synthetic
gctaccgtgatacaaagctttgttgatacaaccataaaatgataattacacccacgaattgataattatcacacccataaattgatattgcctcttcatggtctaaacttggatcctgtgtcacgtatcg

SEQ ID NO: 1401 - DNA, 130 bp, Artificial Sequence
  Synthetic
gctaccgtgatacaaagctttgttgatacaaccataaaatgataattacacctgtaaattgataattatcacacccataaattgatattgcctcttcatggtctaaacttggatcctgtgtcacgtatcg

SEQ ID NO: 1402 - DNA, 130 bp, Artificial Sequence
  Synthetic
gctaccgtgatacaaagctttgttgatacaaccataaaatgataattacattcataaattgataattatcacacccataaattgatattgcctcttcatggtctaaacttggatcctgtgtcacgtatcg

SEQ ID NO: 1403 - DNA, 130 bp, Artificial Sequence
  Synthetic
gctaccgtgatacaaagctttgttgatacaaccataaaatgataattatgcccataaattgataattatcacacccataaattgatattgcctcttcatggtctaaacttggatcctgtgtcacgtatcg

SEQ ID NO: 1404 - DNA, 130 bp, Artificial Sequence
  Synthetic
gctaccgtgatacaaagctttgttgatacaaccataaaatgataatcgcacccataaattgataattatcacacccataaattgatattgcctcttcatggtctaaacttggatcctgtgtcacgtatcg

SEQ ID NO: 1405 - DNA, 130 bp, Artificial Sequence
  Synthetic
gctaccgtgatacaaagctttgttgatacaaccataaaatgatagctacacccataaattgataattatcacacccataaattgatattgcctcttcatggtctaaacttggatcctgtgtcacgtatcg

SEQ ID NO: 1406 - DNA, 130 bp, Artificial Sequence
  Synthetic
gctaccgtgatacaaagctttgttgatacaaccataaaatgacgattacacccataaattgataattatcacacccataaattgatattgcctcttcatggtctaaacttggatcctgtgtcacgtatcg

SEQ ID NO: 1407 - DNA, 130 bp, Artificial Sequence
  Synthetic
gctaccgtgatacaaagctttgttgatacaaccataaaatagtaattacacccataaattgataattatcacacccataaattgatattgcctcttcatggtctaaacttggatcctgtgtcacgtatcg

SEQ ID NO: 1408 - DNA, 130 bp, Artificial Sequence
  Synthetic
gctaccgtgatacaaagctttgttgatacaaccataaagcgataattacacccataaattgataattatcacacccataaattgatattgcctcttcatggtctaaacttggatcctgtgtcacgtatcg

SEQ ID NO: 1409 - DNA, 130 bp, Artificial Sequence
  Synthetic
gctaccgtgatacaaagctttgttgatacaaccataggatgataattacacccataaattgataattatcacacccataaattgatattgcctcttcatggtctaaacttggatcctgtgtcacgtatcg

SEQ ID NO: 1410 - DNA, 130 bp, Artificial Sequence
  Synthetic
gctaccgtgatacaaagctttgttgatacaaccacgaaatgataattacacccataaattgataattatcacacccataaattgatattgcctcttcatggtctaaacttggatcctgtgtcacgtatcg

SEQ ID NO: 1411 - DNA, 130 bp, Artificial Sequence
  Synthetic
gctaccgtgatacaaagctttgttgatacaactgtaaaatgataattacacccataaattgataattatcacacccataaattgatattgcctcttcatggtctaaacttggatcctgtgtcacgtatcg

SEQ ID NO: 1412 - DNA, 130 bp, Artificial Sequence
  Synthetic
gctaccgtgatacaaagctttgttgatacagtcataaaatgataattacacccataaattgataattatcacacccataaattgatattgcctcttcatggtctaaacttggatcctgtgtcacgtatcg

SEQ ID NO: 1413 - DNA, 130 bp, Artificial Sequence
  Synthetic
gctaccgtgatacaaagctttgttgatatgaccataaaatgataattacacccataaattgataattatcacacccataaattgatattgcctcttcatggtctaaacttggatcctgtgtcacgtatcg

SEQ ID NO: 1414 - DNA, 130 bp, Artificial Sequence
  Synthetic
gctaccgtgatacaaagctttgttgacgcaaccataaaatgataattacacccataaattgataattatcacacccataaattgatattgcctcttcatggtctaaacttggatcctgtgtcacgtatcg

SEQ ID NO: 1415 - DNA, 130 bp, Artificial Sequence
  Synthetic
gctaccgtgatacaaagctttgttagtacaaccataaaatgataattacacccataaattgataattatcacacccataaattgatattgcctcttcatggtctaaacttggatcctgtgtcacgtatcg

SEQ ID NO: 1416 - DNA, 130 bp, Artificial Sequence
  Synthetic
gctaccgtgatacaaagctttgccgatacaaccataaaatgataattacacccataaattgataattatcacacccataaattgatattgcctcttcatggtctaaacttggatcctgtgtcacgtatcg

SEQ ID NO: 1417 - DNA, 130 bp, Artificial Sequence
  Synthetic
gctaccgtgatacaaagcttcattgatacaaccataaaatgataattacacccataaattgataattatcacacccataaattgatattgcctcttcatggtctaaacttggatcctgtgtcacgtatcg

SEQ ID NO: 1418 - DNA, 130 bp, Artificial Sequence
  Synthetic
cagttcttggtcgaaagctttgttgatacaaccataaaatgataattacacccataaattgataattatcacacccataaattgatattgcctcttcatggtctaaacttggatcctctcaagtctgtgg

SEQ ID NO: 1419 - DNA, 130 bp, Artificial Sequence
  Synthetic
cagttcttggtcgaaagcttagttgatacaaccataaaatgataattacacccataaattgataattatcacacccataaattgatattgcctcttcatggtctaaacttggatcctctcaagtctgtgg

SEQ ID NO: 1420 - DNA, 130 bp, Artificial Sequence
  Synthetic
cagttcttggtcgaaagcttggttgatacaaccataaaatgataattacacccataaattgataattatcacacccataaattgatattgcctcttcatggtctaaacttggatcctctcaagtctgtgg

SEQ ID NO: 1421 - DNA, 130 bp, Artificial Sequence
  Synthetic
cagttcttggtcgaaagcttcgttgatacaaccataaaatgataattacacccataaattgataattatcacacccataaattgatattgcctcttcatggtctaaacttggatcctctcaagtctgtgg

SEQ ID NO: 1422 - DNA, 130 bp, Artificial Sequence
  Synthetic
cagttcttggtcgaaagcttttttgatacaaccataaaatgataattacacccataaattgataattatcacacccataaattgatattgcctcttcatggtctaaacttggatcctctcaagtctgtgg

SEQ ID NO: 1423 - DNA, 130 bp, Artificial Sequence
  Synthetic
cagttcttggtcgaaagctttattgatacaaccataaaatgataattacacccataaattgataattatcacacccataaattgatattgcctcttcatggtctaaacttggatcctctcaagtctgtgg

SEQ ID NO: 1424 - DNA, 130 bp, Artificial Sequence
  Synthetic
cagttcttggtcgaaagctttcttgatacaaccataaaatgataattacacccataaattgataattatcacacccataaattgatattgcctcttcatggtctaaacttggatcctctcaagtctgtgg

SEQ ID NO: 1425 - DNA, 130 bp, Artificial Sequence
  Synthetic
cagttcttggtcgaaagctttgatgatacaaccataaaatgataattacacccataaattgataattatcacacccataaattgatattgcctcttcatggtctaaacttggatcctctcaagtctgtgg

SEQ ID NO: 1426 - DNA, 130 bp, Artificial Sequence
  Synthetic
cagttcttggtcgaaagctttggtgatacaaccataaaatgataattacacccataaattgataattatcacacccataaattgatattgcctcttcatggtctaaacttggatcctctcaagtctgtgg

SEQ ID NO: 1427 - DNA, 130 bp, Artificial Sequence
  Synthetic
cagttcttggtcgaaagctttgctgatacaaccataaaatgataattacacccataaattgataattatcacacccataaattgatattgcctcttcatggtctaaacttggatcctctcaagtctgtgg

SEQ ID NO: 1428 - DNA, 130 bp, Artificial Sequence
  Synthetic
cagttcttggtcgaaagctttgtagatacaaccataaaatgataattacacccataaattgataattatcacacccataaattgatattgcctcttcatggtctaaacttggatcctctcaagtctgtgg

SEQ ID NO: 1429 - DNA, 130 bp, Artificial Sequence
  Synthetic
cagttcttggtcgaaagctttgtggatacaaccataaaatgataattacacccataaattgataattatcacacccataaattgatattgcctcttcatggtctaaacttggatcctctcaagtctgtgg

SEQ ID NO: 1430 - DNA, 130 bp, Artificial Sequence
  Synthetic
cagttcttggtcgaaagctttgtcgatacaaccataaaatgataattacacccataaattgataattatcacacccataaattgatattgcctcttcatggtctaaacttggatcctctcaagtctgtgg

SEQ ID NO: 1431 - DNA, 130 bp, Artificial Sequence
  Synthetic
cagttcttggtcgaaagctttgtttatacaaccataaaatgataattacacccataaattgataattatcacacccataaattgatattgcctcttcatggtctaaacttggatcctctcaagtctgtgg

SEQ ID NO: 1432 - DNA, 130 bp, Artificial Sequence
  Synthetic
cagttcttggtcgaaagctttgttaatacaaccataaaatgataattacacccataaattgataattatcacacccataaattgatattgcctcttcatggtctaaacttggatcctctcaagtctgtgg

SEQ ID NO: 1433 - DNA, 130 bp, Artificial Sequence
  Synthetic
cagttcttggtcgaaagctttgttcatacaaccataaaatgataattacacccataaattgataattatcacacccataaattgatattgcctcttcatggtctaaacttggatcctctcaagtctgtgg

SEQ ID NO: 1434 - DNA, 130 bp, Artificial Sequence
  Synthetic
cagttcttggtcgaaagctttgttgttacaaccataaaatgataattacacccataaattgataattatcacacccataaattgatattgcctcttcatggtctaaacttggatcctctcaagtctgtgg

SEQ ID NO: 1435 - DNA, 130 bp, Artificial Sequence
  Synthetic
cagttcttggtcgaaagctttgttggtacaaccataaaatgataattacacccataaattgataattatcacacccataaattgatattgcctcttcatggtctaaacttggatcctctcaagtctgtgg

SEQ ID NO: 1436 - DNA, 130 bp, Artificial Sequence
  Synthetic
cagttcttggtcgaaagctttgttgctacaaccataaaatgataattacacccataaattgataattatcacacccataaattgatattgcctcttcatggtctaaacttggatcctctcaagtctgtgg

SEQ ID NO: 1437 - DNA, 130 bp, Artificial Sequence
  Synthetic
cagttcttggtcgaaagctttgttgaaacaaccataaaatgataattacacccataaattgataattatcacacccataaattgatattgcctcttcatggtctaaacttggatcctctcaagtctgtgg

SEQ ID NO: 1438 - DNA, 130 bp, Artificial Sequence
  Synthetic
cagttcttggtcgaaagctttgttgagacaaccataaaatgataattacacccataaattgataattatcacacccataaattgatattgcctcttcatggtctaaacttggatcctctcaagtctgtgg

SEQ ID NO: 1439 - DNA, 130 bp, Artificial Sequence
  Synthetic
cagttcttggtcgaaagctttgttgacacaaccataaaatgataattacacccataaattgataattatcacacccataaattgatattgcctcttcatggtctaaacttggatcctctcaagtctgtgg

SEQ ID NO: 1440 - DNA, 130 bp, Artificial Sequence
  Synthetic
cagttcttggtcgaaagctttgttgattcaaccataaaatgataattacacccataaattgataattatcacacccataaattgatattgcctcttcatggtctaaacttggatcctctcaagtctgtgg

SEQ ID NO: 1441 - DNA, 130 bp, Artificial Sequence
  Synthetic
cagttcttggtcgaaagctttgttgatgcaaccataaaatgataattacacccataaattgataattatcacacccataaattgatattgcctcttcatggtctaaacttggatcctctcaagtctgtgg

SEQ ID NO: 1442 - DNA, 130 bp, Artificial Sequence
  Synthetic
cagttcttggtcgaaagctttgttgatccaaccataaaatgataattacacccataaattgataattatcacacccataaattgatattgcctcttcatggtctaaacttggatcctctcaagtctgtgg

SEQ ID NO: 1443 - DNA, 130 bp, Artificial Sequence
  Synthetic
ggaaaggtactcgaagcttcaaggcagttccgggctgaatgaagcgccgtgttgatacaaccataaaatgataattacacccataaattgataattatcacacccaggatccgggtttgacactgagtag

SEQ ID NO: 1444 - DNA, 130 bp, Artificial Sequence
  Synthetic
ggaaaggtactcgaagcttcaaggcagttccgggctgaatgaagcgccgtgttgttacaaccataaaatgataattacacccataaattgataattatcacacccaggatccgggtttgacactgagtag

SEQ ID NO: 1445 - DNA, 130 bp, Artificial Sequence
  Synthetic
ggaaaggtactcgaagcttcaaggcagttccgggctgaatgaagcgccgtgtggatacaaccataaaatgataattacacccataaattgataattatcacacccaggatccgggtttgacactgagtag

SEQ ID NO: 1446 - DNA, 130 bp, Artificial Sequence
  Synthetic
ggaaaggtactcgaagcttcaaggcagttccgggctgaatgaagcgccgtgttgatacaaccctaaaatgataattacacccataaattgataattatcacacccaggatccgggtttgacactgagtag

SEQ ID NO: 1447 - DNA, 130 bp, Artificial Sequence
  Synthetic
ggaaaggtactcgaagcttcaaggcagttccgggctgaatgaagcgccgtgttgatacaaccaaaaaatgataattacacccataaattgataattatcacacccaggatccgggtttgacactgagtag

SEQ ID NO: 1448 - DNA, 130 bp, Artificial Sequence
  Synthetic
ggaaaggtactcgaagcttcaaggcagttccgggctgaatgaagcgccgtgttgatacaaccatacaatgataattacacccataaattgataattatcacacccaggatccgggtttgacactgagtag

SEQ ID NO: 1449 - DNA, 130 bp, Artificial Sequence
  Synthetic
ggaaaggtactcgaagcttcaaggcagttccgggctgaatgaagcgccgtgttgatacaaccataatatgataattacacccataaattgataattatcacacccaggatccgggtttgacactgagtag

SEQ ID NO: 1450 - DNA, 130 bp, Artificial Sequence
  Synthetic
ggaaaggtactcgaagcttcaaggcagttccgggctgaatgaagcgccgtgttgatacaaccataaaatgataattacacccataaatggataattatcacacccaggatccgggtttgacactgagtag

SEQ ID NO: 1451 - DNA, 130 bp, Artificial Sequence
  Synthetic
ggaaaggtactcgaagcttcaaggcagttccgggctgaatgaagcgccgtgttgatacaaccataaaatgataattacacccataaattgttaattatcacacccaggatccgggtttgacactgagtag

SEQ ID NO: 1452 - DNA, 130 bp, Artificial Sequence
  Synthetic
ggaaaggtactcgaagcttcaaggcagttccgggctgaatgaagcgccgtgttgatacaaccataaaatgataattacacccataaattgacaattatcacacccaggatccgggtttgacactgagtag

SEQ ID NO: 1453 - DNA, 130 bp, Artificial Sequence
  Synthetic
ggaaaggtactcgaagcttcaaggcagttccgggctgaatgaagcgccgtgttgatacaaccataaaatgataattacacccataaattgatcattatcacacccaggatccgggtttgacactgagtag

SEQ ID NO: 1454 - DNA, 130 bp, Artificial Sequence
  Synthetic
ggaaaggtactcgaagcttcaaggcagttccgggctgaatgaagcgccgtgttgatacaaccataaaatgataattacacccataaattgataattatcacaaccaggatccgggtttgacactgagtag

SEQ ID NO: 1455 - DNA, 130 bp, Artificial Sequence
  Synthetic
ggaaaggtactcgaagcttcaaggcagttccgggctgaatgaagcgcctgttgatacaaccataaaatgataattacacccataaattgataattatcacacccaaggatccgggtttgacactgagtag

SEQ ID NO: 1456 - DNA, 130 bp, Artificial Sequence
  Synthetic
ggaaaggtactcgaagcttcaaggcagttccgggctgaatgaagcgcctgttaatacaaccataaaatgataattacacccataaattgataattatcacacccaaggatccgggtttgacactgagtag

SEQ ID NO: 1457 - DNA, 130 bp, Artificial Sequence
  Synthetic
ggaaaggtactcgaagcttcaaggcagttccgggctgaatgaagcgcctgttggtacaaccataaaatgataattacacccataaattgataattatcacacccaaggatccgggtttgacactgagtag

SEQ ID NO: 1458 - DNA, 130 bp, Artificial Sequence
  Synthetic
ggaaaggtactcgaagcttcaaggcagttccgggctgaatgaagcgcctgttgatacaaccataacatgataattacacccataaattgataattatcacacccaaggatccgggtttgacactgagtag

SEQ ID NO: 1459 - DNA, 130 bp, Artificial Sequence
  Synthetic
ggaaaggtactcgaagcttcaaggcagttccgggctgaatgaagcgcctgttgatacaaccataaattgataattacacccataaattgataattatcacacccaaggatccgggtttgacactgagtag

SEQ ID NO: 1460 - DNA, 130 bp, Artificial Sequence
  Synthetic
ggaaaggtactcgaagcttcaaggcagttccgggctgaatgaagcgcctgttgatacaaccataaaatcataattacacccataaattgataattatcacacccaaggatccgggtttgacactgagtag

SEQ ID NO: 1461 - DNA, 130 bp, Artificial Sequence
  Synthetic
ggaaaggtactcgaagcttcaaggcagttccgggctgaatgaagcgcctgttgatacaaccataaaatgttaattacacccataaattgataattatcacacccaaggatccgggtttgacactgagtag

SEQ ID NO: 1462 - DNA, 130 bp, Artificial Sequence
  Synthetic
ggaaaggtactcgaagcttcaaggcagttccgggctgaatgaagcgcctgttgatacaaccataaaatgacaattacacccataaattgataattatcacacccaaggatccgggtttgacactgagtag

SEQ ID NO: 1463 - DNA, 130 bp, Artificial Sequence
  Synthetic
ggaaaggtactcgaagcttcaaggcagttccgggctgaatgaagcgcctgttgatacaaccataaaatgatcattacacccataaattgataattatcacacccaaggatccgggtttgacactgagtag

SEQ ID NO: 1464 - DNA, 130 bp, Artificial Sequence
  Synthetic
ggaaaggtactcgaagcttcaaggcagttccgggctgaatgaagcgcctgttgatacaaccataaaatgataattaaacccataaattgataattatcacacccaaggatccgggtttgacactgagtag

SEQ ID NO: 1465 - DNA, 130 bp, Artificial Sequence
  Synthetic
ggaaaggtactcgaagcttcaaggcagttccgggctgaatgaagcgcctgttgatacaaccataaaatgataattacccccataaattgataattatcacacccaaggatccgggtttgacactgagtag

SEQ ID NO: 1466 - DNA, 130 bp, Artificial Sequence
  Synthetic
ggaaaggtactcgaagcttcaaggcagttccgggctgaatgaagcgcctgttgatacaaccataaaatgataattacaaccataaattgataattatcacacccaaggatccgggtttgacactgagtag

SEQ ID NO: 1467 - DNA, 130 bp, Artificial Sequence
  Synthetic
ggaaaggtactcgaagcttcaaggcagttccgggctgaatgaagcgcctgttgatacaaccataaaatgataattacacccacaaattgataattatcacacccaaggatccgggtttgacactgagtag

SEQ ID NO: 1468 - DNA, 130 bp, Artificial Sequence
  Synthetic
ggaaaggtactcgaagcttcaaggcagttccgggctgaatgaagcgcctgttgatacaaccataaaatgataattacacccatcaattgataattatcacacccaaggatccgggtttgacactgagtag

SEQ ID NO: 1469 - DNA, 130 bp, Artificial Sequence
  Synthetic
ggaaaggtactcgaagcttcaaggcagttccgggctgaatgaagcgcctgttgatacaaccataaaatgataattacacccataaattaataattatcacacccaaggatccgggtttgacactgagtag

SEQ ID NO: 1470 - DNA, 130 bp, Artificial Sequence
  Synthetic
ggaaaggtactcgaagcttcaaggcagttccgggctgaatgaagcgcctgttgatacaaccataaaatgataattacacccataaattggtaattatcacacccaaggatccgggtttgacactgagtag

SEQ ID NO: 1471 - DNA, 130 bp, Artificial Sequence
  Synthetic
ggaaaggtactcgaagcttcaaggcagttccgggctgaatgaagcgcctgttgatacaaccataaaatgataattacacccataaattgataattatcccacccaaggatccgggtttgacactgagtag

SEQ ID NO: 1472 - DNA, 130 bp, Artificial Sequence
  Synthetic
ggaaaggtactcgaagcttcaaggcagttccgggctgaatgaagcgcctgttgatacaaccataaaatgataattacacccataaattgataattataacacccaaggatccgggtttgacactgagtag

SEQ ID NO: 1473 - DNA, 130 bp, Artificial Sequence
  Synthetic
ggaaaggtactcgaagcttcaaggcagttccgggctgaatgaagcgctgttgatacaaccataaaatgataattacacccataaattgataattatcacacccagcggatccgggtttgacactgagtag

SEQ ID NO: 1474 - DNA, 130 bp, Artificial Sequence
  Synthetic
ggaaaggtactcgaagcttcaaggcagttccgggctgaatgaagcgctgttgatacaaccacaaaatgataattacacccataaattgataattatcacacccagcggatccgggtttgacactgagtag

SEQ ID NO: 1475 - DNA, 130 bp, Artificial Sequence
  Synthetic
ggaaaggtactcgaagcttcaaggcagttccgggctgaatgaagcgctgttgatacaaccatcaaatgataattacacccataaattgataattatcacacccagcggatccgggtttgacactgagtag

SEQ ID NO: 1476 - DNA, 130 bp, Artificial Sequence
  Synthetic
ggaaaggtactcgaagcttcaaggcagttccgggctgaatgaagcgctgttgatacaaccataaaataataattacacccataaattgataattatcacacccagcggatccgggtttgacactgagtag

SEQ ID NO: 1477 - DNA, 130 bp, Artificial Sequence
  Synthetic
ggaaaggtactcgaagcttcaaggcagttccgggctgaatgaagcgctgttgatacaaccataaaatggtaattacacccataaattgataattatcacacccagcggatccgggtttgacactgagtag

SEQ ID NO: 1478 - DNA, 130 bp, Artificial Sequence
  Synthetic
ggaaaggtactcgaagcttcaaggcagttccgggctgaatgaagcgctgttgatacaaccataaaatgataattacacccctaaattgataattatcacacccagcggatccgggtttgacactgagtag

SEQ ID NO: 1479 - DNA, 130 bp, Artificial Sequence
  Synthetic
ggaaaggtactcgaagcttcaaggcagttccgggctgaatgaagcgctgttgatacaaccataaaatgataattacacccaaaaattgataattatcacacccagcggatccgggtttgacactgagtag

SEQ ID NO: 1480 - DNA, 130 bp, Artificial Sequence
  Synthetic
ggaaaggtactcgaagcttcaaggcagttccgggctgaatgaagcgctgttgatacaaccataaaatgataattacacccatcaattgataattatcacacccagcggatccgggtttgacactgagtag

SEQ ID NO: 1481 - DNA, 130 bp, Artificial Sequence
  Synthetic
ggaaaggtactcgaagcttcaaggcagttccgggctgaatgaagcgctgttgatacaaccataaaatgataattacacccataatttgataattatcacacccagcggatccgggtttgacactgagtag

SEQ ID NO: 1482 - DNA, 130 bp, Artificial Sequence
  Synthetic
ggaaaggtactcgaagcttcaaggcagttccgggctgaatgaagcgctgttgatacaaccatcaaataataattacacccaaaatttgataattatcacacccagcggatccgggtttgacactgagtag

SEQ ID NO: 1483 - DNA, 130 bp, Artificial Sequence
  Synthetic
ggaaaggtactcgaagcttcaaggcagttccgggctgaatgaagcgctgttgatacaaccatcaaatggtaattacacccaaaatttgataattatcacacccagcggatccgggtttgacactgagtag

SEQ ID NO: 1484 - DNA, 130 bp, Artificial Sequence
  Synthetic
ggaaaggtactcgaagcttcaaggcagttccgggctgaatgaagcgctgttgatacaaccatcaaataataattacacccaacaattgataattatcacacccagcggatccgggtttgacactgagtag

SEQ ID NO: 1485 - DNA, 130 bp, Artificial Sequence
  Synthetic
ggaaaggtactcgaagcttcaaggcagttccgggctgaatgaagcgctgttgatacaaccatcaaatggtaattacacccaacaattgataattatcacacccagcggatccgggtttgacactgagtag

SEQ ID NO: 1486 - DNA, 130 bp, Artificial Sequence
  Synthetic
ctgttgatacaaccataaaatgataattacacccataaattgataattatcacacccataaattgatattgcgatttaggagttgatttaatcaactttagtggaccaatcacgtgatcatggatggtag

SEQ ID NO: 1487 - DNA, 130 bp, Artificial Sequence
  Synthetic
ctgttgatacaaccataaaatgataattagcacccataaattgataattatcacacccataaattgatattgcatttaggagttgatttaatcaactttagtggaccaatcacgtgatcatggatggtag

SEQ ID NO: 1488 - DNA, 130 bp, Artificial Sequence
  Synthetic
ctgttgatacaaccataaaatgataattagacacccataaattgataattatcacacccataaattgatattgctttaggagttgatttaatcaactttagtggaccaatcacgtgatcatggatggtag

SEQ ID NO: 1489 - DNA, 130 bp, Artificial Sequence
  Synthetic
ctgttgatacaaccataaaatgataattagatcacccataaattgataattatcacacccataaattgatattgcttaggagttgatttaatcaactttagtggaccaatcacgtgatcatggatggtag

SEQ ID NO: 1490 - DNA, 130 bp, Artificial Sequence
  Synthetic
ctgttgatacaaccataaaatgataattagattcacccataaattgataattatcacacccataaattgatattgctaggagttgatttaatcaactttagtggaccaatcacgtgatcatggatggtag

SEQ ID NO: 1491 - DNA, 130 bp, Artificial Sequence
  Synthetic
ctgttgatacaaccataaaatgataattagatttcacccataaattgataattatcacacccataaattgatattgcaggagttgatttaatcaactttagtggaccaatcacgtgatcatggatggtag

SEQ ID NO: 1492 - DNA, 130 bp, Artificial Sequence
  Synthetic
ctgttgatacaaccataaaatgataattagatttacacccataaattgataattatcacacccataaattgatattgcggagttgatttaatcaactttagtggaccaatcacgtgatcatggatggtag

SEQ ID NO: 1493 - DNA, 130 bp, Artificial Sequence
  Synthetic
ctgttgatacaaccataaaatgataattagatttagcacccataaattgataattatcacacccataaattgatattgcgagttgatttaatcaactttagtggaccaatcacgtgatcatggatggtag

SEQ ID NO: 1494 - DNA, 130 bp, Artificial Sequence
  Synthetic
ctgttgatacaaccataaaatgataattagatttaggcacccataaattgataattatcacacccataaattgatattgcagttgatttaatcaactttagtggaccaatcacgtgatcatggatggtag

SEQ ID NO: 1495 - DNA, 130 bp, Artificial Sequence
  Synthetic
ctgttgatacaaccataaaatgataattagatttaggacacccataaattgataattatcacacccataaattgatattgcgttgatttaatcaactttagtggaccaatcacgtgatcatggatggtag

SEQ ID NO: 1496 - DNA, 130 bp, Artificial Sequence
  Synthetic
ctgttgatacaaccataaaatgataattagatttaggagcacccataaattgataattatcacacccataaattgatattgcttgatttaatcaactttagtggaccaatcacgtgatcatggatggtag

SEQ ID NO: 1497 - DNA, 130 bp, Artificial Sequence
  Synthetic
ctgttgatacaaccataaaatgataattagatttaggagtcacccataaattgataattatcacacccataaattgatattgctgatttaatcaactttagtggaccaatcacgtgatcatggatggtag

SEQ ID NO: 1498 - DNA, 130 bp, Artificial Sequence
  Synthetic
ctgttgatacaaccataaaatgataattagatttaggagttcacccataaattgataattatcacacccataaattgatattgcgatttaatcaactttagtggaccaatcacgtgatcatggatggtag

SEQ ID NO: 1499 - DNA, 130 bp, Artificial Sequence
  Synthetic
ctgttgatacaaccataaaatgataattagatttaggagttgcacccataaattgataattatcacacccataaattgatattgcatttaatcaactttagtggaccaatcacgtgatcatggatggtag

SEQ ID NO: 1500 - DNA, 130 bp, Artificial Sequence
  Synthetic
ctgttgatacaaccataaaatgataattagatttaggagttgacacccataaattgataattatcacacccataaattgatattgctttaatcaactttagtggaccaatcacgtgatcatggatggtag

SEQ ID NO: 1501 - DNA, 130 bp, Artificial Sequence
  Synthetic
ctgttgatacaaccataaaatgataattagatttaggagttgatcacccataaattgataattatcacacccataaattgatattgcttaatcaactttagtggaccaatcacgtgatcatggatggtag

SEQ ID NO: 1502 - DNA, 130 bp, Artificial Sequence
  Synthetic
ctgttgatacaaccataaaatgataattagatttaggagttgattcacccataaattgataattatcacacccataaattgatattgctaatcaactttagtggaccaatcacgtgatcatggatggtag

SEQ ID NO: 1503 - DNA, 130 bp, Artificial Sequence
  Synthetic
ctgttgatacaaccataaaatgataattagatttaggagttgatttcacccataaattgataattatcacacccataaattgatattgcaatcaactttagtggaccaatcacgtgatcatggatggtag

SEQ ID NO: 1504 - DNA, 130 bp, Artificial Sequence
  Synthetic
ctgttgatacaaccataaaatgataattagatttaggagttgatttacacccataaattgataattatcacacccataaattgatattgcatcaactttagtggaccaatcacgtgatcatggatggtag

SEQ ID NO: 1505 - DNA, 130 bp, Artificial Sequence
  Synthetic
ctgttgatacaaccataaaatgataattagatttaggagttgatttaacacccataaattgataattatcacacccataaattgatattgctcaactttagtggaccaatcacgtgatcatggatggtag

SEQ ID NO: 1506 - DNA, 130 bp, Artificial Sequence
  Synthetic
ctgttgatacaaccataaaatgataattagatttaggagttgatttaatcacccataaattgataattatcacacccataaattgatattgccaactttagtggaccaatcacgtgatcatggatggtag

SEQ ID NO: 1507 - DNA, 130 bp, Artificial Sequence
  Synthetic
ctgttgatacaaccataaaatgataattagatttaggagttgatttaatccacccataaattgataattatcacacccataaattgatattgcaactttagtggaccaatcacgtgatcatggatggtag

SEQ ID NO: 1508 - DNA, 130 bp, Artificial Sequence
  Synthetic
ctgttgatacaaccataaaatgataattagatttaggagttgatttaatcacacccataaattgataattatcacacccataaattgatattgcactttagtggaccaatcacgtgatcatggatggtag

SEQ ID NO: 1509 - DNA, 130 bp, Artificial Sequence
  Synthetic
ctgttgatacaaccataaaatgataattagatttaggagttgatttaatcaacacccataaattgataattatcacacccataaattgatattgcctttagtggaccaatcacgtgatcatggatggtag

SEQ ID NO: 1510 - DNA, 130 bp, Artificial Sequence
  Synthetic
ctgttgatacaaccataaaatgataattagatttaggagttgatttaatcaaccacccataaattgataattatcacacccataaattgatattgctttagtggaccaatcacgtgatcatggatggtag

SEQ ID NO: 1511 - DNA, 130 bp, Artificial Sequence
  Synthetic
ctgttgatacaaccataaaatgataattagatttaggagttgatttaatcaactcacccataaattgataattatcacacccataaattgatattgcttagtggaccaatcacgtgatcatggatggtag

SEQ ID NO: 1512 - DNA, 130 bp, Artificial Sequence
  Synthetic
ctgttgatacaaccataaaatgataattagatttaggagttgatttaatcaacttcacccataaattgataattatcacacccataaattgatattgctagtggaccaatcacgtgatcatggatggtag

SEQ ID NO: 1513 - DNA, 130 bp, Artificial Sequence
  Synthetic
ctgttgatacaaccataaaatgataattagatttaggagttgatttaatcaactttcacccataaattgataattatcacacccataaattgatattgcagtggaccaatcacgtgatcatggatggtag

SEQ ID NO: 1514 - DNA, 130 bp, Artificial Sequence
  Synthetic
ctgttgatacaaccataaaatgataattagatttaggagttgatttaatcaactttacacccataaattgataattatcacacccataaattgatattgcgtggaccaatcacgtgatcatggatggtag

SEQ ID NO: 1515 - DNA, 130 bp, Artificial Sequence
  Synthetic
ctgttgatacaaccataaaatgataattagatttaggagttgatttaatcaactttagcacccataaattgataattatcacacccataaattgatattgctggaccaatcacgtgatcatggatggtag

SEQ ID NO: 1516 - DNA, 130 bp, Artificial Sequence
  Synthetic
ctgttgatacaaccataaaatgataattagatttaggagttgatttaatcaactttagtcacccataaattgataattatcacacccataaattgatattgcggaccaatcacgtgatcatggatggtag

SEQ ID NO: 1517 - DNA, 130 bp, Artificial Sequence
  Synthetic
ctgttgatacaaccataaaatgataattagatttaggagttgatttaatcaactttagtgcacccataaattgataattatcacacccataaattgatattgcgaccaatcacgtgatcatggatggtag

SEQ ID NO: 1518 - DNA, 130 bp, Artificial Sequence
  Synthetic
ctgttgatacaaccataaaatgataattagatttaggagttgatttaatcaactttagtggcacccataaattgataattatcacacccataaattgatattgcaccaatcacgtgatcatggatggtag

SEQ ID NO: 1519 - DNA, 130 bp, Artificial Sequence
  Synthetic
ctgttgatacaaccataaaatgataattagatttaggagttgatttaatcaactttagtggacacccataaattgataattatcacacccataaattgatattgcccaatcacgtgatcatggatggtag

SEQ ID NO: 1520 - DNA, 130 bp, Artificial Sequence
  Synthetic
ctgttgatacaaccataaaatgataattagatttaggagttgatttaatcaactttagtggaccacccataaattgataattatcacacccataaattgatattgccaatcacgtgatcatggatggtag

SEQ ID NO: 1521 - DNA, 27 bp, Artificial Sequence
  Synthetic
ccttctagactgctgacatactcgatt

SEQ ID NO: 1522 - DNA, 27 bp, Artificial Sequence
  Synthetic
ctcggtacctgttgatgcaaccataaa

SEQ ID NO: 1523 - DNA, 130 bp, Artificial Sequence
  Synthetic
tgttgatgcaaccataaagtgatatttaataattatttataatcagcaacttaaccacaaaacaaccatatattgatatctcacaaaacaaccataagttgatatttttgtgaatcgagtatgtcagcag

SEQ ID NO: 1524 - DNA, 130 bp, Artificial Sequence
  Synthetic
tgttgatgcaaccataaagtgatatttataattatttataatcagcaacttaaccacaaaacaaccatatattgatatctcacaaaacaaccataagttgatattttatgtgaatcgagtatgtcagcag

SEQ ID NO: 1525 - DNA, 130 bp, Artificial Sequence
  Synthetic
tgttgatgcaaccataaagtgatatttaaattatttataatcagcaacttaaccacaaaacaaccatatattgatatctcacaaaacaaccataagttgatattttcatgtgaatcgagtatgtcagcag

SEQ ID NO: 1526 - DNA, 130 bp, Artificial Sequence
  Synthetic
tgttgatgcaaccataaagtgatatttaattatttataatcagcaacttaaccacaaaacaaccatatattgatatctcacaaaacaaccataagttgatatttttcatgtgaatcgagtatgtcagcag

SEQ ID NO: 1527 - DNA, 130 bp, Artificial Sequence
  Synthetic
tgttgatgcaaccataaagtgatatttattatttataatcagcaacttaaccacaaaacaaccatatattgatatctcacaaaacaaccataagttgatattttatcatgtgaatcgagtatgtcagcag

SEQ ID NO: 1528 - DNA, 130 bp, Artificial Sequence
  Synthetic
tgttgatgcaaccataaagtgatatttatatttataatcagcaacttaaccacaaaacaaccatatattgatatctcacaaaacaaccataagttgatattttaatcatgtgaatcgagtatgtcagcag

SEQ ID NO: 1529 - DNA, 130 bp, Artificial Sequence
  Synthetic
tgttgatgcaaccataaagtgatatttaatttataatcagcaacttaaccacaaaacaaccatatattgatatctcacaaaacaaccataagttgatattttcaatcatgtgaatcgagtatgtcagcag

SEQ ID NO: 1530 - DNA, 130 bp, Artificial Sequence
  Synthetic
tgttgatgcaaccataaagtgatatttatttataatcagcaacttaaccacaaaacaaccatatattgatatctcacaaaacaaccataagttgatattttccaatcatgtgaatcgagtatgtcagcag

SEQ ID NO: 1531 - DNA, 130 bp, Artificial Sequence
  Synthetic
tgttgatgcaaccataaagtgatatttattataatcagcaacttaaccacaaaacaaccatatattgatatctcacaaaacaaccataagttgatattttaccaatcatgtgaatcgagtatgtcagcag

SEQ ID NO: 1532 - DNA, 130 bp, Artificial Sequence
  Synthetic
tgttgatgcaaccataaagtgatatttatataatcagcaacttaaccacaaaacaaccatatattgatatctcacaaaacaaccataagttgatattttgaccaatcatgtgaatcgagtatgtcagcag

SEQ ID NO: 1533 - DNA, 130 bp, Artificial Sequence
  Synthetic
tgttgatgcaaccataaagtgatatttaataatcagcaacttaaccacaaaacaaccatatattgatatctcacaaaacaaccataagttgatattttggaccaatcatgtgaatcgagtatgtcagcag

SEQ ID NO: 1534 - DNA, 130 bp, Artificial Sequence
  Synthetic
tgttgatgcaaccataaagtgatatttataatcagcaacttaaccacaaaacaaccatatattgatatctcacaaaacaaccataagttgatatttttggaccaatcatgtgaatcgagtatgtcagcag

SEQ ID NO: 1535 - DNA, 130 bp, Artificial Sequence
  Synthetic
tgttgatgcaaccataaagtgatatttaaatcagcaacttaaccacaaaacaaccatatattgatatctcacaaaacaaccataagttgatattttgtggaccaatcatgtgaatcgagtatgtcagcag

SEQ ID NO: 1536 - DNA, 130 bp, Artificial Sequence
  Synthetic
tgttgatgcaaccataaagtgatatttaatcagcaacttaaccacaaaacaaccatatattgatatctcacaaaacaaccataagttgatattttagtggaccaatcatgtgaatcgagtatgtcagcag

SEQ ID NO: 1537 - DNA, 130 bp, Artificial Sequence
  Synthetic
tgttgatgcaaccataaagtgatatttatcagcaacttaaccacaaaacaaccatatattgatatctcacaaaacaaccataagttgatatttttagtggaccaatcatgtgaatcgagtatgtcagcag

SEQ ID NO: 1538 - DNA, 130 bp, Artificial Sequence
  Synthetic
tgttgatgcaaccataaagtgatatttacagcaacttaaccacaaaacaaccatatattgatatctcacaaaacaaccataagttgatattttttagtggaccaatcatgtgaatcgagtatgtcagcag

SEQ ID NO: 1539 - DNA, 130 bp, Artificial Sequence
  Synthetic
tgttgatgcaaccataaagtgatatttaagcaacttaaccacaaaacaaccatatattgatatctcacaaaacaaccataagttgatatttttttagtggaccaatcatgtgaatcgagtatgtcagcag

SEQ ID NO: 1540 - DNA, 130 bp, Artificial Sequence
  Synthetic
tgttgatgcaaccataaagtgatatttagcaacttaaccacaaaacaaccatatattgatatctcacaaaacaaccataagttgatattttctttagtggaccaatcatgtgaatcgagtatgtcagcag

SEQ ID NO: 1541 - DNA, 130 bp, Artificial Sequence
  Synthetic
tgttgatgcaaccataaagtgatatttacaacttaaccacaaaacaaccatatattgatatctcacaaaacaaccataagttgatattttactttagtggaccaatcatgtgaatcgagtatgtcagcag

SEQ ID NO: 1542 - DNA, 130 bp, Artificial Sequence
  Synthetic
tgttgatgcaaccataaagtgatatttaaacttaaccacaaaacaaccatatattgatatctcacaaaacaaccataagttgatattttaactttagtggaccaatcatgtgaatcgagtatgtcagcag

SEQ ID NO: 1543 - DNA, 130 bp, Artificial Sequence
  Synthetic
tgttgatgcaaccataaagtgatatttaacttaaccacaaaacaaccatatattgatatctcacaaaacaaccataagttgatattttcaactttagtggaccaatcatgtgaatcgagtatgtcagcag

SEQ ID NO: 1544 - DNA, 130 bp, Artificial Sequence
  Synthetic
tgttgatgcaaccataaagtgatatttacttaaccacaaaacaaccatatattgatatctcacaaaacaaccataagttgatatttttcaactttagtggaccaatcatgtgaatcgagtatgtcagcag

SEQ ID NO: 1545 - DNA, 130 bp, Artificial Sequence
  Synthetic
tgttgatgcaaccataaagtgatatttattaaccacaaaacaaccatatattgatatctcacaaaacaaccataagttgatattttatcaactttagtggaccaatcatgtgaatcgagtatgtcagcag

SEQ ID NO: 1546 - DNA, 130 bp, Artificial Sequence
  Synthetic
tgttgatgcaaccataaagtgatatttataaccacaaaacaaccatatattgatatctcacaaaacaaccataagttgatattttaatcaactttagtggaccaatcatgtgaatcgagtatgtcagcag

SEQ ID NO: 1547 - DNA, 130 bp, Artificial Sequence
  Synthetic
tgttgatgcaaccataaagtgatatttaaaccacaaaacaaccatatattgatatctcacaaaacaaccataagttgatatttttaatcaactttagtggaccaatcatgtgaatcgagtatgtcagcag

SEQ ID NO: 1548 - DNA, 130 bp, Artificial Sequence
  Synthetic
tgttgatgcaaccataaagtgatatttaaccacaaaacaaccatatattgatatctcacaaaacaaccataagttgatattttttaatcaactttagtggaccaatcatgtgaatcgagtatgtcagcag

SEQ ID NO: 1549 - DNA, 130 bp, Artificial Sequence
  Synthetic
tgttgatgcaaccataaagtgatatttaccacaaaacaaccatatattgatatctcacaaaacaaccataagttgatatttttttaatcaactttagtggaccaatcatgtgaatcgagtatgtcagcag

SEQ ID NO: 1550 - DNA, 130 bp, Artificial Sequence
  Synthetic
tgttgatgcaaccataaagtgatatttacacaaaacaaccatatattgatatctcacaaaacaaccataagttgatattttatttaatcaactttagtggaccaatcatgtgaatcgagtatgtcagcag

SEQ ID NO: 1551 - DNA, 130 bp, Artificial Sequence
  Synthetic
tgttgatgcaaccataaagtgatatttaacaaaacaaccatatattgatatctcacaaaacaaccataagttgatattttgatttaatcaactttagtggaccaatcatgtgaatcgagtatgtcagcag

SEQ ID NO: 1552 - DNA, 130 bp, Artificial Sequence
  Synthetic
tgttgatgcaaccataaagtgatatttacaaaacaaccatatattgatatctcacaaaacaaccataagttgatatttttgatttaatcaactttagtggaccaatcatgtgaatcgagtatgtcagcag

SEQ ID NO: 1553 - DNA, 130 bp, Artificial Sequence
  Synthetic
tgttgatgcaaccataaagtgatatttaaaaacaaccatatattgatatctcacaaaacaaccataagttgatattttttgatttaatcaactttagtggaccaatcatgtgaatcgagtatgtcagcag

SEQ ID NO: 1554 - DNA, 130 bp, Artificial Sequence
  Synthetic
tgttgatgcaaccataaagtgatatttaaaacaaccatatattgatatctcacaaaacaaccataagttgatattttgttgatttaatcaactttagtggaccaatcatgtgaatcgagtatgtcagcag

SEQ ID NO: 1555 - DNA, 130 bp, Artificial Sequence
  Synthetic
tgttgatgcaaccataaagtgatatttaaacaaccatatattgatatctcacaaaacaaccataagttgatattttagttgatttaatcaactttagtggaccaatcatgtgaatcgagtatgtcagcag

SEQ ID NO: 1556 - DNA, 130 bp, Artificial Sequence
  Synthetic
tgttgatgcaaccataaagtgatatttaacaaccatatattgatatctcacaaaacaaccataagttgatattttgagttgatttaatcaactttagtggaccaatcatgtgaatcgagtatgtcagcag

SEQ ID NO: 1557 - DNA, 130 bp, Artificial Sequence
  Synthetic
tgttgatgcaaccataaagtgatatttacaaccatatattgatatctcacaaaacaaccataagttgatattttggagttgatttaatcaactttagtggaccaatcatgtgaatcgagtatgtcagcag

SEQ ID NO: 1558 - DNA, 130 bp, Artificial Sequence; identical to SEQ ID NO: 1523
  Synthetic

SEQ ID NO: 1559 - DNA, 130 bp, Artificial Sequence
  Synthetic
tgttgatgcaaccataaagtgatatttaataattatttataatcagcaacttaaccacaaaacaaccatatattgatatctcacaaacaaccataagttgatattttatgtgaatcgagtatgtcagcag

SEQ ID NO: 1560 - DNA, 130 bp, Artificial Sequence
  Synthetic
tgttgatgcaaccataaagtgatatttaataattatttataatcagcaacttaaccacaaaacaaccatatattgatatctcacaacaaccataagttgatattttcatgtgaatcgagtatgtcagcag

SEQ ID NO: 1561 - DNA, 130 bp, Artificial Sequence
  Synthetic
tgttgatgcaaccataaagtgatatttaataattatttataatcagcaacttaaccacaaaacaaccatatattgatatctcacacaaccataagttgatatttttcatgtgaatcgagtatgtcagcag

SEQ ID NO: 1562 - DNA, 130 bp, Artificial Sequence
  Synthetic
tgttgatgcaaccataaagtgatatttaataattatttataatcagcaacttaaccacaaaacaaccatatattgatatctcaccaaccataagttgatattttatcatgtgaatcgagtatgtcagcag

SEQ ID NO: 1563 - DNA, 130 bp, Artificial Sequence
  Synthetic
tgttgatgcaaccataaagtgatatttaataattatttataatcagcaacttaaccacaaaacaaccatatattgatatctcacaaccataagttgatattttaatcatgtgaatcgagtatgtcagcag

SEQ ID NO: 1564 - DNA, 130 bp, Artificial Sequence
  Synthetic
tgttgatgcaaccataaagtgatatttaataattatttataatcagcaacttaaccacaaaacaaccatatattgatatctccaaccataagttgatattttcaatcatgtgaatcgagtatgtcagcag

SEQ ID NO: 1565 - DNA, 130 bp, Artificial Sequence; identical to SEQ ID NO: 1523
  Synthetic

SEQ ID NO: 1566 - DNA, 130 bp, Artificial Sequence
  Synthetic
tgttgatgcaaccataaagtgatatttataaattatttataatcagcaacttaaccacaaaacaaccatatattgatatctcacaaaacaaccataagttgatatttttgtgaatcgagtatgtcagcag

SEQ ID NO: 1567 - DNA, 130 bp, Artificial Sequence
  Synthetic
tgttgatgcaaccataaagtgatatttaatttttatttataatcagcaacttaaccacaaaacaaccatatattgatatctcacaaaacaaccataagttgatatttttgtgaatcgagtatgtcagcag

SEQ ID NO: 1568 - DNA, 130 bp, Artificial Sequence
  Synthetic
tgttgatgcaaccataaagtgatatttaataaaaatttataatcagcaacttaaccacaaaacaaccatatattgatatctcacaaaacaaccataagttgatatttttgtgaatcgagtatgtcagcag

SEQ ID NO: 1569 - DNA, 130 bp, Artificial Sequence
  Synthetic
tgttgatgcaaccataaagtgatatttaataatttattataatcagcaacttaaccacaaaacaaccatatattgatatctcacaaaacaaccataagttgatatttttgtgaatcgagtatgtcagcag

SEQ ID NO: 1570 - DNA, 130 bp, Artificial Sequence
  Synthetic
tgttgatgcaaccataaagtgatatttaataattataaataatcagcaacttaaccacaaaacaaccatatattgatatctcacaaaacaaccataagttgatatttttgtgaatcgagtatgtcagcag

SEQ ID NO: 1571 - DNA, 130 bp, Artificial Sequence
  Synthetic
tgttgatgcaaccataaagtgatatttaataattattttaaatcagcaacttaaccacaaaacaaccatatattgatatctcacaaaacaaccataagttgatatttttgtgaatcgagtatgtcagcag

SEQ ID NO: 1572 - DNA, 130 bp, Artificial Sequence
  Synthetic
tgttgatgcaaccataaagtgatatttaataattatttattttcagcaacttaaccacaaaacaaccatatattgatatctcacaaaacaaccataagttgatatttttgtgaatcgagtatgtcagcag

SEQ ID NO: 1573 - DNA, 130 bp, Artificial Sequence
  Synthetic
tgttgatgcaaccataaagtgatatttaataattatttataaagagcaacttaaccacaaaacaaccatatattgatatctcacaaaacaaccataagttgatatttttgtgaatcgagtatgtcagcag

SEQ ID NO: 1574 - DNA, 130 bp, Artificial Sequence
  Synthetic
tgttgatgcaaccataaagtgatatttaataattatttataatctccaacttaaccacaaaacaaccatatattgatatctcacaaaacaaccataagttgatatttttgtgaatcgagtatgtcagcag

SEQ ID NO: 1575 - DNA, 130 bp, Artificial Sequence
  Synthetic
tgttgatgcaaccataaagtgatatttaataattatttataatcaggtacttaaccacaaaacaaccatatattgatatctcacaaaacaaccataagttgatatttttgtgaatcgagtatgtcagcag

SEQ ID NO: 1576 - DNA, 130 bp, Artificial Sequence
  Synthetic
tgttgatgcaaccataaagtgatatttaataattatttataatcagcatgttaaccacaaaacaaccatatattgatatctcacaaaacaaccataagttgatatttttgtgaatcgagtatgtcagcag

SEQ ID NO: 1577 - DNA, 130 bp, Artificial Sequence
  Synthetic
tgttgatgcaaccataaagtgatatttaataattatttataatcagcaacaaaaccacaaaacaaccatatattgatatctcacaaaacaaccataagttgatatttttgtgaatcgagtatgtcagcag

SEQ ID NO: 1578 - DNA, 130 bp, Artificial Sequence
  Synthetic
tgttgatgcaaccataaagtgatatttaataattatttataatcagcaacttttccacaaaacaaccatatattgatatctcacaaaacaaccataagttgatatttttgtgaatcgagtatgtcagcag

SEQ ID NO: 1579 - DNA, 130 bp, Artificial Sequence
  Synthetic
tgttgatgcaaccataaagtgatatttaataattatttataatcagcaacttaaggacaaaacaaccatatattgatatctcacaaaacaaccataagttgatatttttgtgaatcgagtatgtcagcag

SEQ ID NO: 1580 - DNA, 130 bp, Artificial Sequence
  Synthetic
tgttgatgcaaccataaagtgatatttaataattatttataatcagcaacttaacctgaaaacaaccatatattgatatctcacaaaacaaccataagttgatatttttgtgaatcgagtatgtcagcag

SEQ ID NO: 1581 - DNA, 130 bp, Artificial Sequence
  Synthetic
tgttgatgcaaccataaagtgatatttaataattatttataatcagcaacttaaccacttaacaaccatatattgatatctcacaaaacaaccataagttgatatttttgtgaatcgagtatgtcagcag

SEQ ID NO: 1582 - DNA, 130 bp, Artificial Sequence
  Synthetic
tgttgatgcaaccataaagtgatatttagcaattatttataatcagcaacttaaccacaaaacaaccatatattgatatctcacaaaacaaccataagttgatatttttgtgaatcgagtatgtcagcag

SEQ ID NO: 1583 - DNA, 130 bp, Artificial Sequence
  Synthetic
tgttgatgcaaccataaagtgatatttaatggttatttataatcagcaacttaaccacaaaacaaccatatattgatatctcacaaaacaaccataagttgatatttttgtgaatcgagtatgtcagcag

SEQ ID NO: 1584 - DNA, 130 bp, Artificial Sequence
  Synthetic
tgttgatgcaaccataaagtgatatttaataaccatttataatcagcaacttaaccacaaaacaaccatatattgatatctcacaaaacaaccataagttgatatttttgtgaatcgagtatgtcagcag

SEQ ID NO: 1585 - DNA, 130 bp, Artificial Sequence
  Synthetic
tgttgatgcaaccataaagtgatatttaataattgcttataatcagcaacttaaccacaaaacaaccatatattgatatctcacaaaacaaccataagttgatatttttgtgaatcgagtatgtcagcag

SEQ ID NO: 1586 - DNA, 130 bp, Artificial Sequence
  Synthetic
tgttgatgcaaccataaagtgatatttaataattatccataatcagcaacttaaccacaaaacaaccatatattgatatctcacaaaacaaccataagttgatatttttgtgaatcgagtatgtcagcag

SEQ ID NO: 1587 - DNA, 130 bp, Artificial Sequence
  Synthetic
tgttgatgcaaccataaagtgatatttaataattatttgcaatcagcaacttaaccacaaaacaaccatatattgatatctcacaaaacaaccataagttgatatttttgtgaatcgagtatgtcagcag

SEQ ID NO: 1588 - DNA, 130 bp, Artificial Sequence
  Synthetic
tgttgatgcaaccataaagtgatatttaataattatttatggtcagcaacttaaccacaaaacaaccatatattgatatctcacaaaacaaccataagttgatatttttgtgaatcgagtatgtcagcag

SEQ ID NO: 1589 - DNA, 130 bp, Artificial Sequence
  Synthetic
tgttgatgcaaccataaagtgatatttaataattatttataactagcaacttaaccacaaaacaaccatatattgatatctcacaaaacaaccataagttgatatttttgtgaatcgagtatgtcagcag

SEQ ID NO: 1590 - DNA, 130 bp, Artificial Sequence
  Synthetic
tgttgatgcaaccataaagtgatatttaataattatttataatcgacaacttaaccacaaaacaaccatatattgatatctcacaaaacaaccataagttgatatttttgtgaatcgagtatgtcagcag

SEQ ID NO: 1591 - DNA, 130 bp, Artificial Sequence
  Synthetic
tgttgatgcaaccataaagtgatatttaataattatttataatcagtgacttaaccacaaaacaaccatatattgatatctcacaaaacaaccataagttgatatttttgtgaatcgagtatgtcagcag

SEQ ID NO: 1592 - DNA, 130 bp, Artificial Sequence
  Synthetic
tgttgatgcaaccataaagtgatatttaataattatttataatcagcagtttaaccacaaaacaaccatatattgatatctcacaaaacaaccataagttgatatttttgtgaatcgagtatgtcagcag

SEQ ID NO: 1593 - DNA, 130 bp, Artificial Sequence
  Synthetic
tgttgatgcaaccataaagtgatatttaataattatttataatcagcaacccaaccacaaaacaaccatatattgatatctcacaaaacaaccataagttgatatttttgtgaatcgagtatgtcagcag

SEQ ID NO: 1594 - DNA, 130 bp, Artificial Sequence
  Synthetic
tgttgatgcaaccataaagtgatatttaataattatttataatcagcaacttggccacaaaacaaccatatattgatatctcacaaaacaaccataagttgatatttttgtgaatcgagtatgtcagcag

SEQ ID NO: 1595 - DNA, 130 bp, Artificial Sequence
  Synthetic
tgttgatgcaaccataaagtgatatttaataattatttataatcagcaacttaattacaaaacaaccatatattgatatctcacaaaacaaccataagttgatatttttgtgaatcgagtatgtcagcag

SEQ ID NO: 1596 - DNA, 130 bp, Artificial Sequence
  Synthetic
tgttgatgcaaccataaagtgatatttaataattatttataatcagcaacttaaccgtaaaacaaccatatattgatatctcacaaaacaaccataagttgatatttttgtgaatcgagtatgtcagcag

SEQ ID NO: 1597 - DNA, 130 bp, Artificial Sequence
  Synthetic
tgttgatgcaaccataaagtgatatttaataattatttataatcagcaacttaaccacggaacaaccatatattgatatctcacaaaacaaccataagttgatatttttgtgaatcgagtatgtcagcag

SEQ ID NO: 1598 - DNA, 130 bp, Artificial Sequence; identical to SEQ ID NO: 1597
  Synthetic

SEQ ID NO: 1599 - DNA, 130 bp, Artificial Sequence
  Synthetic
tgttgatgcaaccataaagtgatatttaataattatttataatcagcaacttaaccacaaaacaaccatatattgatatctctcaaaacaaccataagttgatatttttgtgaatcgagtatgtcagcag

SEQ ID NO: 1600 - DNA, 130 bp, Artificial Sequence
  Synthetic
tgttgatgcaaccataaagtgatatttaataattatttataatcagcaacttaaccacaaaacaaccatatattgatatctcagaaaacaaccataagttgatatttttgtgaatcgagtatgtcagcag

SEQ ID NO: 1601 - DNA, 130 bp, Artificial Sequence
  Synthetic
tgttgatgcaaccataaagtgatatttaataattatttataatcagcaacttaaccacaaaacaaccatatattgatatctcactaaacaaccataagttgatatttttgtgaatcgagtatgtcagcag

SEQ ID NO: 1602 - DNA, 130 bp, Artificial Sequence
  Synthetic
tgttgatgcaaccataaagtgatatttaataattatttataatcagcaacttaaccacaaaacaaccatatattgatatctcacataacaaccataagttgatatttttgtgaatcgagtatgtcagcag

SEQ ID NO: 1603 - DNA, 130 bp, Artificial Sequence
  Synthetic
tgttgatgcaaccataaagtgatatttaataattatttataatcagcaacttaaccacaaaacaaccatatattgatatctcacaatacaaccataagttgatatttttgtgaatcgagtatgtcagcag

SEQ ID NO: 1604 - DNA, 130 bp, Artificial Sequence
  Synthetic
tgttgatgcaaccataaagtgatatttaataattatttataatcagcaacttaaccacaaaacaaccatatattgatatctcacaaatcaaccataagttgatatttttgtgaatcgagtatgtcagcag

SEQ ID NO: 1605 - DNA, 130 bp, Artificial Sequence
  Synthetic
tgttgatgcaaccataaagtgatatttaataattatttataatcagcaacttaaccacaaaacaaccatatattgatatctcgcaaaacaaccataagttgatatttttgtgaatcgagtatgtcagcag

SEQ ID NO: 1606 - DNA, 130 bp, Artificial Sequence
  Synthetic
tgttgatgcaaccataaagtgatatttaataattatttataatcagcaacttaaccacaaaacaaccatatattgatatctcataaaacaaccataagttgatatttttgtgaatcgagtatgtcagcag

SEQ ID NO: 1607 - DNA, 130 bp, Artificial Sequence
  Synthetic
tgttgatgcaaccataaagtgatatttaataattatttataatcagcaacttaaccacaaaacaaccatatattgatatctcacgaaacaaccataagttgatatttttgtgaatcgagtatgtcagcag

SEQ ID NO: 1608 - DNA, 130 bp, Artificial Sequence
  Synthetic
tgttgatgcaaccataaagtgatatttaataattatttataatcagcaacttaaccacaaaacaaccatatattgatatctcacagaacaaccataagttgatatttttgtgaatcgagtatgtcagcag

SEQ ID NO: 1609 - DNA, 130 bp, Artificial Sequence
  Synthetic
tgttgatgcaaccataaagtgatatttaataattatttataatcagcaacttaaccacaaaacaaccatatattgatatctcacaagacaaccataagttgatatttttgtgaatcgagtatgtcagcag

SEQ ID NO: 1610 - DNA, 130 bp, Artificial Sequence
  Synthetic
tgttgatgcaaccataaagtgatatttaataattatttataatcagcaacttaaccacaaaacaaccatatattgatatctcacaaagcaaccataagttgatatttttgtgaatcgagtatgtcagcag

SEQ ID NO: 1611 - DNA, 1940 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccaccggtagacctaggtccaagctcgttccgttattaggattaagctggaagagccttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1612 - DNA, 3455 bp, Artificial Sequence
  Synthetic
gtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagcccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaa

SEQ ID NO: 1613 - DNA, 2930 bp, Artificial Sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccaccggtcaagctttgttgatacaaccataaaatgataattacacccataaattgataattatcacacccataaattgatattgcctcttcatggtctaaacttcagtaagtttacgacattttcatgaagaggtcatttcaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtacccctaggtccaagctcgttccgttattaggattaagctggaagagccttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 1614 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagctaaaccttaaattaatcggaaaaattgttgaaacaaccataaagtgatatttacaaccatatattgatatttggtgcaaccataacttgatattgcctcttcatagtctagacttatgtaagtttacgacaaaatcgtgaagaggcaatattatgtctgctctaccttctccttctactaccaccctgattgcacttgaaagtgcatttgttactcctgctcgaaacttaactaagtcgcgtgggaaaaacatacaccgttacgtcagtgctaagaagaggcagtccctcttagaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccctgcccaagtcttatgaatgagtgtccgtgactgatgcaaggttatcggaactgtaatgattatatgttttctaattttgaagtggttcttttgatgagttttgccagttgctgaaagtaactttcttactgcagtagttttgctgaaatactcgattcacaaaaatatcaacttatggttgttttgtgagatatcaatatatggttgttttgtggttaagttgctgattataaataattattaaatatcactttatggttgcatcaacaaaaatcgaatgattaagagccgtttgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1615 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcaagcttaatatttttcaataaatagtgttgaaacaaccataagttgatatttacaaccataagctgatatttaatacaaccataacttgatattgcctctttttagaccatacttatgtaagtttactacatatggtgaaagaggcaattttatgcaaccttctcctgcaacgacatatcaaacagactctcctcttgagttcgcatttactcaaccagctagaaagttaacaaaatctcgtgggaaaaatatacatcgttacgttagcattaaaacaaagcgagccctgagttgggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccctgtgcagctaccacctgttatccccctagtatcagaattgtttcaaccacagcgagaatcttacaatattcaatactaatgccataaatatacttaaacagtaaaaaagatgtaagtaactttcttacaatcaatcttcataattagtaataaacctatgaaaatatcaacttatggttgttttgaataatatcaacatatggttgtatttttattaagaaattgatttatataaaaatattgaatatcaagttatggttgtatcaacaaatagtattgaaacagccttataaagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1616 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcactgccacccaaattcctcatttggtgttgtttgaagtataagttgacatatttgtactaaaagatggcataaattggaagtataaggtggcatagtctagtatttaaccaaatggttagatggttgactcacatgtacagaagaaaactcaaacactcccgtgttaaaaaccttcataaatttgctagtcaaaaaaataaatctacctgtttagttgaatcctctttagagtttgatgcctgttttcattttgaattttcaccatcaatagccgattagacggacgcaatcttgggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccggtagctcggctgtgaatgaaatggacttaccaattaaagtaaaaggtgatgatttattcatcaaagtttttgtgccagtgtaaaccattttccaaactgtttaagagtgatttacaacgcgtagcatgtttactttgcgttttataaagctgtatttggtagctttatgccatctattgcttcaatactatgccaatatacacttcacttaccacgctgtaagttaataaaaccgagtttggttatgtcaacttatacttcaaacaacatttgggtgaaaatacattcctttttgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1617 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcaggctgccacccaaatttccccctttgttgtttgaagtataagttgacaaatttgaagttaaagttgacataaatttgaacaataagttgtcatagcctattttttagtcagtgcgctaaaaaaagaaacggctatgtatagacgcaatcccaagtcatctagagtcaaacaccaattcaaattcgctagtcaaaagagcaagaacacttgtttcgcagaatcagcattagagttcgatgcttgtttccactttgagtattcctcagcgattgtccagtttttgctcggcatcctggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgtcccgttctgggaatggaaactggtcggctctaactcatttctgtccaaaaatgaattggtgtgaacgtctgattatttaattagttgtatgacgcactagccgaacgactgaaaatgcacaaaaggtacgcgcgaggggcaatattaggacagtaagggactttttgtcatcttttacttcaaacttatgtcaacttatacttccgtaacacccagatagagcctagggcaagggcccgtcttatgtcaacttatacttcaaacgacacccttgttgtttgaagtataagttggacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1618 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagctggggcttccacccatctgaagctttgtagtttgcaccataagcctgcatatcttccttgataccctgcataattggtacaataagcgtgcataagctatttttgttgtagtttaacaacaaacaggctggtctactatgtaccgccgaaagctcaaacattcccgcgtaaaaaatctttttaagttcgtcagtgccaaaatgaatcaggctatgacggttgaatcctacttagagttcgatacctgctttcacctagaatattcatcatccatcccaactaggaagtgactcttggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgtgaacaccgtgtactgatgcgcaatccaataagagtcgttaatagctctaagcaagataagcccgcttgatgcgggttttgtttctttgaggcatctggttctgttcttcatgtaagaaaataacttacatgtaactgagaggcagaatgttcgcatgtagtgttatgtcgggttatgctgcctttttatgcatgcttatggtgaagagaaataactaagcttctgatttataagtggttggctatgtagccttatggtgcaagctacaagcttgaaaattttccacaagtctagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1619 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagctttttagctatagctttatttttcatgtcgctgaaagcatacattgacataagacaaccatagtctgacaaatttaaagcatagtttgacataaaatagcatttttgtattttagctacataatttaatattattaaaatcaattacttgagttaaaagttaaagcgtagtctgacaaatttgacaaaacatcgagcagctgtacactaagtgtacctaagttgcttgagttttgcgcatgtatattcgaaatttacgtaagccttcgcccaataagaaggctggcctgtgtgtaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgatcaagtggccgacagcttcgagttaggagtaggtcttgagttttaaagaatgagaatagctaaattattgccattcttctaaatcatataatgtaaatgatatttgtcgcattatgttgtcataaaagtacatggaaaagttttggctccagagattgcttcaatttgtcagcttacggttatattttatgtcaggatatggttatatttttcaactaagctattgaaagtttgaagcgacctatgtcaggttatgcttccagcgacatttcagttagtggtcgataacaacagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1620 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcatgtggctggggcctccgcccatcttgtcgctgaaagcataaagtgtccaattaaaagcataagctgtccttttaaaactcataaagtgtcctaaacttaatttggttgttttattacaacgttaagggacaagttatgtacgttcgaaatctccgcaaaccatctgcaacaaaaaatgtgtacaagtttgcgagttctaaaaaccgaagtgtcattttgtgtgaaagttctttagaacgagattgttgttaccatctcgaatactctaaggacgagcgcggatcactttttaagggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgcaacaagccctgcccttaaagagcataaggcctaactgatttatgtccaaaaaattgttatacgtaagatgccagtatttgttcaatgttaatgctgaaaacactcgtttttcgtaagtaagtttctttcatgcccagatatcgcttgttctaacgaacaatacatgggacaccttattctttcagtttaggacgctttatggttttagattgattttaactatttgattttctgtgatcgcataggacatcttatgctttcagcgacacatctgacgttctaaaaatccaattgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1621 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgatgtggctggggcctccgcccatctgatgtttgcaaaataagttcgcataaattgcagaatatttcgcaaatttgcactataagtctgcatagactacgttttgttgtaggtttacaacaaaagtgacttagctatgtttgaccaaactaagaaatcatctcatgtgcacaacatctgtaagttcatgagcttgaagaatgatgctgttgttcgcactctctccattctggagttcgatttctgttttcacctcgaatacaacccaaacatcaactagcttgtgagggtggttaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtacctgggtagccgtaatcaagaactttctctgttttatatgttgtccaagaaatactgacgcctatcacatcctcaaattgtactctgtgagtagaaatgtaagacatcgatcattgaaagaatattgttgtagtaactttacaacgtagaatttagatacctactcaaatatgctgacttttgatgcaatcttatgcgaacttattctgcaaatttcttcgtaactacttgaaagctagctctgtctatgcagacttatgctgcaagcatcaccatctgacgttctaaaaatccaatgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1622 - DNA, 11816 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataactagcgaattccgagcgaaggagatatacatatgaaaacgatgttactgcaacgaccaaagccatttgaagatgaaagtcttgagagctatttaatccgaatagcaaacagaaatggttatcaagatgttgatcgttttttgtctgcacttaaacactatttgtgtgatggggattctgaaaaattttcctcattccccactgacatccgtcgaataaacccatattcctcaaaacatagttcagctgctagaagtcatgctctccataagataggtcaattaacatttacggaatccgttgatttactgaagttagccatcaatcgttcgccacttaaatattccccctcagtaacagcagttatccgtggtcacgaggttttccctcgctctttactaaggaccaatatcataccagtatgccctgtttgccttcaggaaaatggttacgccagctatttatggcattttgaaggttatgactactgccatattcacgatctcgctctaacgtataactgtcaatgtggcaaaccttgcgactaccgagtaagcggtttacaactagtttgcagctcatgtggaacgacactaactcatttattagaaaagccaactgataggtcatccgatatttctcactggctggcaggcgaaaccataaaatggttgccagcagttcccgtaagttatcgttgggggctagttcattggtggatgaataataaaaaatcaaaagaactggaaacagagagcttcacgattttttggaaaaattggcccaattcctttcataacctaattcaagaaactcttagttacaatcagacctactcactggtagcacccacccaatggagacttaaagacttactaggggaaatactttttagctcaataaacttgccaggtcgaaatctacaatacaacttgatactgagagagcttttccattatctggaaaatcatttgtgggaaaacaatggattaattgcaaacctaagactaagcgcctttgaggtttctctaattttaggctgtagcactgaagaagtagcgtctatgtcagaacaaggattgttgattcccatacaaaaccggaaacgttatgaacctatgagtctaacaaactgcatttttcattttggtgacgtcttttgcatttggttagctgaatttcagacagacgagttcaaccgttcattttatacctcacgatggtgataaaatgactttagatgagctattggcaactactaaatatgaagaattagtatcttcaactaaacggtcatttcgtccattatccccactgattgacatcactaacaatccgatgacggcattgactatcttagtcaatctgacagagaaagggatctccaataaaaatcttcttgataaagagcgttgtaaagaaaaactgagggatgacaaatggtgggctgcggtccttaagccagcccaataccgtcacagccataatgttaaatttcctgatattcgttctacaggcacaattcgtacagtagcacctgataaccttccggcttatttcatcacgtcgagcaaactgcctaacgtaggatggacttactcaaaggattcctctgacatcaatcgctgtctgttttttacctctgaatttttatgggctggacaaccatgctgtttagccagagcgttaacggatagtgaacacccactttggagtacactcaaaaaacttgggtgttatgagaaaaataaaaaactggcagcaaagctgctttctcaaatccccggcgaactcattgatgttgatttaaccggaaattacctcagccaagtttcttttccagatggtcgggatagttatctgtctttctctcccgtcgcatctcaagctatgcaaagttgtgtttatcaatcactagaacagcattatcgacaaacggcccttatgcgatttgaccgagcaaccaatatggggctactttcagccagttgtggtggccgatttcgcctgattgaaacgaaaccctacatcaaagataaacgacaccactatatttcagaactaccaaactggctcaccaaagaagctattcaatcagtagagcagtttctaagatcagaacaatggctagttacccataatgataagccacgtaatatggcgatagtaaaatcttccattcgttctatggtgaatcgctggttaagctctcgtacaaatacagaagccctgtctccggctgagttagcggaacaacttaataacgacatagcttccaaacgtattataaaaagatacgcttaccaacctaagttgactcggttattcatacaacttatagaaaatactggagaagataacgcttacaaagaagatagaaaaccgacaacgaatagtcagtaccttttgatccctgaactcagaatctctggaggttctgccataagttcatcggtcagtgtaggactattttcaatgatgtcgctttatggatttatccatgcgtttgaacggaatatgcagcttgtactgacgagttttaccattgatagttttgccatttgcgtccatgactatcacttggaaaaacgagggttaaccaaagagccgattaaaaaggcaaaagtacgcaaagatgaacaagaaaaaatagcacctcctgctatctatgatgattatcaattcgatagttgtatcagtctaattatcaaaacatcagaatcaaaaactatacccgctgaaaaaatggtggcattacttccaaaacgctttgcgaggggcgcaatccgattgtccattgatggcattcaagaaataggagcgtttcccaagccattacccgcaatacaggcaataaaaaatccacttggtagttggctgtcgtttgaacctgacttgtctttaatatcaactgattcaatagtcgatatagctaccaatcacaataatttatggttgacagtgatgggataccagtatttagaaccacccacaacaaaacctagttcgctacgagactaccctcatgcccttgtcgaaaatatcttgggatttgttaagcctagaaccgtaacaaaatcgaccaatttagatgatctattttggcgctatcaaatccagccatttggcgtctgcttactaccaaggagtatcaaatgaagcttcctatccatctagcctatgaacgctcaatttccccttcagatgttgcctttttagtcatttggccagatggatacaaagagccactgccttgttacagtcgcacaatccttggccttaacgaaggttcacacgttggctatgatggttctggcgccgtacgaaataacttaaaaatgaatacgctggtcgatggcaatattcatgaattggactattgttctgtgccgtatggagcgaaatcaatagagtgttgtttctccgtttccttttcttctgaattactcaagccttataaatgttcagatgcaggcgtaaaaaagacacttagagaatttgttagtctatataaccaacacgtagggttagaagaactgataatcaagtacctgactaatattgcactaggcacctggctttggcacaacaccaaacgaagctattgtgtctccatagaaattcggccgtggccttgggaaggtgagacaatcatcattgatgatatacgcaaatatctcaagggcgatagagcgaccaacgacttactcaactggaacaagctgattgaacaagtaaaagaggctttcacagaccctatgggcttatgcatattggaggtaaaagctaacttaatcaaaccctcgatggcgcagctttatcctagccaaatgttcaaagaagcagccaagaaagagaacaaccgtctctatcaatcaaccatcattgatggtatcaaatcacccattatgggctgttacaaaactggggcggctatcgctactatagatacttggtatccagacgccgaggaaccaattcgggttggtcactacggtgtagatcgagaaaacagtactgcatatcgacatcccgatacaggaaaggacttctttagtattttaaagcgaatagacgaattggttgatcgactaaaagatgccaaagagttaagtcaagacgaactcaaagatatgcatttccttatggctaatctaatcaaaggtgggctatttcaggaaaaaggggaatgacgacatgatactttactatcgaacagttacctttttgccaaaaataaaaaataacgaagcattagtgggacactgtctgaaggttcttcatggtgtatgtactaagtacacaatcaacactatcggagtgtcttttcctgagtggggagaagaaaccatcggtgacaaaattagttttatctcacccaaccagctcgaactggactttttacttcaacaaacctatttttctgaaatgacagcgcttggatacctaaacatatcgcagtcaaaatcggttcctgaacaatacaatttggctgttttccggcgcaatcaaaaaatcgaccaagcgacaccgaatggacaaagaatcagagccgaacgtttggctaaacgagctatgaatagaggcgattcaccgattcggtttaccccagaggacctcgtatttgaacattatcattctataccgataacaagtacccgtagtggcaaatcattcaggctaaatttgcaatatcaacgactagatacagttccagatggacaatgggcattttcaagttatgggttagcaaatcaagagcttgaaagtagtcctgttcccgtaatttgacctttaataaggagatatagcatgtctgctctaccttctccttctactaccaccctgattgcacttgaaagtgcatttgttactcctgctcgaaacttaactaagtcgcgtgggaaaaacatacaccgttacgtcagtgctaagatgggaaaaagagttacagtagaatcttttctcgagtgtgttgcttgttatcattttgattttgagcccagcatcgttcgcttttgttctcagccgataagattttcatacggtctaaatggtaagacccatacttatgttccagactttctagttcaatttgatacaggtgaatttaagttgtacgaagtaaagtccgatatggaaagctcaaaagaggaatttcaatgtgaatgggaagcaaaagttcaaggtgcgtttgagttaggtttggagctagagctggttacagaggaagaaatactggatgaggtcatatttagcaaccttaaacttttgcatcgatatgcttcaagagataacttgaatcactttcatcaaactctccttgccacctttaaattgaatggtacacaaaccgcaaagagtttaggacaccatcttggcctaaatggaagaaaaatattaccgttcctgtgtgatttgctctcacgaaacttactccaaacaagtttagagacgcctctgtcactggagtctgaatttgaattgggttgttatgcctaataaatcattttcgagttttcatcggaagtcagcatttcagcaagaaaaacttgagccgaatgatagggttgttgatgacaacgatgttgacgaagcaacatatcaagatatatccgcatttcctgacaatatagccactcagattacttttcgtctaagtatccttcgttatttagcaagtaagtgcgaacgaatcattccaaagactatcgaaccgcatcgagtcggtctacaacgtttacacgacaggaagattccaagtgccatatcaatataccgttggtggttagttttcagagcgtctggttgtaacccagttagcttagctcccaagaataaaaataagggtaacagtaaagccaaagtaccaacattcgttgatgctttgatggaacaagctgtagacagagttatctctgggagaaaagtgcgtataagaagtgcctacaggcgcgtgcgaaggaaattacgtcagcataatctgaacaatggaacgaagtacaaatacccaacttatgaatctcttcggaaacgggttaaaaagaaaactcctttcgagttactggctgcgaagaagggcgagcgagtcgcgaaaagagagttccgtcgtatgggaaaaaagatattgacttcttacgtccttgaaagggttgaaatagatcatacggtagtggatctctttgctgtacatgaagaacatcgcgtgccattgggccgaccttggcttactcaattagttgattgttacagcaaagcagttattggtttttacctggggtttgaaccaccgagctacgtatctgtgtcacttgctcttaaaaatgcaatactgcggaaagatgaccttttgagttcgttcgactcagtagaaaatgaatggctatgttacggtatccctgacttactcgtaactgataatggtaaagagtttttgtctaaggcttttgataaagcatgtgaatcactgttgatcaatgtacatcaaaacagagtcgaaacgcccgacgataaaccgcatgttgaacgcagctacggaactatcaatacttctctgctagacgatttaccagggaaggcttttagccaataccttcagagagaaggttatgattcagtgggcgaagctactcttacattggatgaaattaaagaaatttacttaatttggttagtcgatatttatcatccaaaatctaaccagagaggtactaattgtccgaatgtagcatggaaaaggggatgtcaagaatgggagcctgaagagtttaatggatctaaagatgaattggactttaaattcgctattgttgatcaaaaacaactaaccaaagctggtgtaactgtttataaagaactgacatacagtagtgaacgtttagctgagtataggggtaagaaaggaaatcataaagttcagttcaaatataatccagagtgtatggcggtcatttgggtgttagatgaggacctgaacgagtacttcacggttcacgcgatagactacgaatatgcaagtagagtgtctctctggcaacataaatacaatatgaagtatcaagcagagttaaattcagcagaatatgacgaggacaaggaaattgatgcagagataaaaattgaagaaatcgctgaccgttcgattgttaagactaagaaaatcagagcccggaggcgtggagctagacatcaagagaatagcgcaagagcaaaatccatcagcgatgccaagcctgtcccatcccagaaacatgaggacgaaattgtaattgttgataatgaagattgggatattgattatgtttaagaaatcatcagatgaatgaaactcgtgaagcacgcatctcaaaagctaaaagagcatttgtatccacgccgagtgttacgaaaatcttatgctacatggatagatgtagagatttatcagacttcgattctgagcctacttgcatgatggtctatggtgcttccggagtcggtaaaacgaccattatcaaaaaatatttaaatcaaaacaggcgagattctgaagttgggggcgatataattccagtcttgcatatagagctgccggacaatgcgaaaccagtagatgctgcgagggagttgctggttgaaatgggggacccgctggcgctttatgaaacagatttagccagattgacgaaaaaactgattgatttaatcccggtggttggtgtgaagttgattattatcgatgagttccagcatttagtagaagaaaggtcaaatcgggttctcacgcaagtaggtaactggctaaaaatgatactcaacaaaacgaaatgtccaatcgttcttttcggcatgccatattcaaaggttgtactacaagctaactcgcaacttcatggacgattttccattcagttcgagctgaggcccttcagttaccagggaggtgaaggcgtattcaaaacttttttggagtacctcgataaggctttaccttttgaaaagcaggctggcttagctaacgaaagtttgcagaaaaaattgtatgcattctctcaaggaaacatgcgctcattgagaaacctcatttatcaagcatctattgaagcgattgataatcagcatgcgacgatcaccgaagaagattttgtttttgcatcgaagttgacctcgggtgataaacctattacctggaaaaatccttttgatgagggtgttaaagtgacggaagatatgttgcgtccgccaccaaaggatattgggtgggaggattattatcataacgttaaacccaaaaaccaaagacgcaagggtagtaatatgtttgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1623 - DNA, 11779 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgtactgccgagtaggcaactgataacagtacagcgcggctgaaatcatcattaaagcggtgtactgccgagtaggcaactgataactagcgaattccgagcgaaggagatatacatatgtttctacaaagaccagagccatattcagatgaaagtttagaaagttttttcatcagagttgcgaacaaaaatggctatgaagatattcatcggttcctcattgtaacaaaaaagtatttacaagatgaaaaccacgatagatttaaggctttccctactgatattaaaacaatcaatccttactcgtctaaaaacaatcatggttcaagagtagcagcactgcacaaaatagcccttatgacttttaatgagcaacctgagatactgtctttagcaataaataggacatctctaatatattcgccatcaacaaccgctctagtacgtggtagtgaggttattcctcgctcattattacgaaaaaacattattccatgttgcccaagatgtttacatgaggaaggttttggacattatttatggcatttcaacggttataattactgccacaaacataatactccattaatatataagtgcgcatgtggcgcagattatgattatcgaatagcaggcttaaatggattttgcagagaatgtgatacgtaccttaatccaaaccaacaacatccagatagtgccgaaagcaaaacttccgcttggctttcaggcaagactatcgagcaactgcctgacttgccccagagctatcgttggggtctaattcattggtggactcaccttactcaaaaagagtttgatggtgcttcctttattgacttttggcatcgttggcctgaatcctttcatcatttaatacaacaaaaaattgaatttaatttagagcattcaattattcatcatgataatttgaagctaaaagatctactgggagatttgttctttaactgtattcgattacctgaaaggaatttaaagtacaacattgtgcttaatgagttattgagatttatagatgataatttatggggtaacaatggacggcttgcaaatctaaaaatgaatgctgtagaagtctctattttcctcaactgctcgtgcgatcaaattgtattaatggtcgaacaacggtttttaaaacccagccggaaagctaaaccaaataaaccattaagttttactgattacttgtttcatctaggagatgtttattgcctttggttagctgaatttcaaaccgatgagtttaatcgaacatttatcatttcgaggtagtcaatgagtacactagctaaaattattaattcatcgtcatcagatataaatgttgaacttaagagagcttttcgcccactgagtccaaatattgacatcaccgacaacgaagatattgctctcatcattttaacgaacctagccgcaaaagtagacgcaaaaaaaaatttgaccgatagagaaaactgtaaaaaaaaattaaaagataacaactggtggtcacgttgtattaatacaatgaaatttcgacaaagccacaatgttaaatttcccgagataaaagcaaccggaataattagagcacacccaatgggtgaaatacccaagtacttactatcttcttcaaaattaaaacaaaaaactttggcttatgcgaatgattcaaaggatgtcagtgtcgctaattttttaatcagtgaatttatcttgcacggcaaaatttgttgcttgggcgtcttgcttacagatgagcagcatcctctctgggatcgtttaacaaaactgggctgttatcaaaaaacacgcaagtacgtagcaaaacaacttaaaaaaattccaaattcttgtattgaagtacagctaggtgctaattctgttcgacagatttcattacctgacgggaataactcttacttatctctatcccctgttacctctcaaacaatgcagagttcatgctatcagtctcttcataaacactattggttaagtaaaattacccgttatagcagagcttcaaatatgggtgtacttccgatgacctgcggtggaacattacgcatgttaagtcatactataagttttgaagatgtcaaacattgccaaatatcgcccaactcatcttggttaactaaagattcaatacaagcattctacgactattttgattcttcaaactggatgatgcctcacattcaaaagcaacaaaagttaaaaatactaaaaatcacaatcacagaaatgatttctcgttggttagcattacaaaaaaacacaatacaacataatcagttagagcttgtacataaactaaatttcgatctatcaaatacaaaatccttgagacaatttgcctacgatccaaaaacaactagatttctatttaccttaattgaaaatagatcaaacacacagcaacctaatgagaactttgataatcaatatcttcttttgcctcaaatttctgtttgtggtgcatctgctatgagttcatccatcactattggaataccctctttaaccgcattttatggctttattcatgcatttgagcgaaacatgcaaaaggtcttttcaaacctaaaagtcgattcatttgctatctgcattcatacttttcacttacaaaaaagagggatgactagggaaagtataataaaattgacaagtaatatatcttcccctgcaactcatgatgaatggcattgtgatctgaaatttagtctggctctcaaagtaaataatcttactcacctcaaccaaagcgaaatattgtatgcattgccaaaacgacttgctggaggctacgcaagaataaatatagatgacataaagacgattcaagtatcttctagctttaaggatttggttaaacaaatacccacttttcaaggacaatggctatccttatacaaggcgaaaattgattcctttgaaagcattattcaacaaataaaagcatcgcaaaatataatcccaacttgtgtgggttatcattacctagaaaagccgacagaacgcacttttgccctaagagactacaaacatgcgtttgctgagcctatcattggactcatcaaaccaataactattaaagaagatacaagtttgcatgatttgttttgggaccaaattaacaagccacactacaccacaatagagacaaggaatatgaataatgaagctccctattagtcttgcttatgaacgatcaatccatcccagcgatgtttgcttttttaccatttggccagatggaaataaagcccctttatcttttatgagccgaacagtacttggtcaaatggaaaccgcatcactcgcttacgatactaaaggaaaccctaaacaaacggctactcctgaagttcttgcacaaggaaaccctcatcacatggatttctgtagcgttccctttggcgcagagcatattgaatgcgttttttcagtttcattctcttcagagcttcgcaaaccttacaagtgtagcgagcctgaagttaaaaacactttgattgagctggtcaagctttatgagtcaaaaatcggttgggatgaactcgcaggtcggtttctaaccaatatttgtcaaggaaaatggttgtggaaaaacacgaaaaaaacgtaccaactaaatattgaaattaaaccttggccttggaaaaataaccccgtcatttttgaagatattagaacaaattacagtacttataatgactgccaatctgataccaaatggcaagaattaaaacaactcatcatcaatgctttctcctcaaaaaatggcctcgctattttcgagataaaagcacaattaactctaccaacaaatgctgagctttacccaagccaagcatttattgaaaaagataagaaagaaaaaaaacatcaatctagccgtatatttcaacatacatcaatcaatggacaaaaaagccctatcataggctgctataaagcaggagctggcatttttatgattgatgattggtatcctaatgcagaagaacctattcgtatagggagattcggtgtacaccaacaagatgtaacttgctatcgccccccttcaactcatcaagatctcttttctttattggagcagtctgaaaaatatatagctttattaaagaatagaaagaaaacacctcaaaaaacaataaatgaactgcactttttaatggctaaccttatcaaaggcgggttgttccagcataaaggagaataaacgatggattggtactataaaacgattcgatttattcctactaattgcaataatgaatttctagcagctaagtgtatcaatatattacacggttttagctaccgttatgatactcactctattggtatttcttttccaaactggtgtaatgaaaccgtaggagatcggatttcatttgtaagcatcgaaaaaatggcattagattacctactcactcaaaattactttaaagaaatgcaagatcttggttacttcgatatatcaaaaacattgattgttccaatcgaatgtaactttgcatgttttaagcgttatcaaaagatcgacaaatcgtcagcggctggttttcatcgaaagataaagaggcttgctaaaagagcgcataatagaggtgaggtttttgataacaagaagtataacatttacaaacaatgcgatattggacactatcattcattagcagaagaaagtaaaagtaaagggtatggatttagattaaacattcaaagaactaatgaaatcagcatcaataatatacctatttttagtagctatggattagcaaacacagcacacgcattacaatctgttcccataatttaacctttaataaggagatatagcatgcaaccttctcctgcaacgacatatcaaacagactctcctcttgagttcgcatttactcaaccagctagaaagttaacaaaatctcgtgggaaaaatatacatcgttacgttagcattaaaatgaatactatcatttcagttgaatcgacattggagttcgatgcctgttttcattttgattttaataaaaatatctctcgattttgctcacaacctattagatatagttatgtcattgatggaattattcgtacttatgttcctgactttttatgcgaattttattgtggtgagatggttctatacgaagttaaggcaccaaatgctgttaattcaaaacgttttactaaagagtttgaggcaaaaagacagtatgcgagaaaactttttgatgtagatcttgaattgattgaagaacacgatattagacatattcctcttcttaaaaacttaaaacgtatgcacagatatgcatctcattctgaattaacttatgagcaaacaactattctgaagtatttgaataaacatggctcaacaaagctcgagacaataattgatcattttagtaatagtaaaaatataattccgatgatttatgatttattgtctaagtacttgataaatactgaccttagagttcttctgaataaccaaactgaattaaagacaacttatgtctaggacatcattttctagttttcatggaaccccaacatctgatagcgaaaatgcttccagtaagctcacatttatcgaaaatgatgatttgcaagatttaacatcatttagcaaaaaagctcaaaatgaagctaaactcagattaagtatacttcgtaatatattgaataaaagttcagaaataaacttagttttaattgaacgcttacgggctgatcttcaacaacaaggagagcgatcaataccaagtgcaattactatctatcgatggtggttaacttataaaaaatcaaactttagtattttatctttagtaccaaagactaagcaaaagggaaatagaaacacgaaagtacctaaaacaatatcagtctatattgatcaagctgttgaacaagtaatttctgccaataaaatcaatgttagtacagcttttagacgagtcagaagaaaagtaagacaatataatcttacccataaaacaaagcatacctacccttcatacgaagccataagaaagcgcgtaaaaaaaatcaccccctatgaaaaattagctgcaagcaaaggagatcgaatagcaaaacgagagttccgtcgtatggggaaaaaaatccaaactgagtacttactagaacgagtagaagttgatcatacatggttagatttatttgctgttcatgaagaacatcgagtacctataggtcgtccttatttaactcaactagtagattgtcatagcaaatcagtaattggtttctaccttggctttgaaccaccaagttatatgtctgttgctttagcattaaaaaatgcaatcaaacgcaaagataatctattacaaaactatccatcaattcaaaatgagtggttatgttatggaatccctgacctacttgttacggataatggtaaagagtttttgtctaaagactttactcttgcttgtgacagtttacttataaacattcatcaaaacagagtagaaacacctgataataaaccgcatacagaacggcagtatggaaccactaacactgaattacttaatgatcttcctggtaaaacatttagtaattacttacaaagagagggctacaattccagcgacgaagcctcattaacattaagtgaaatcaaacaaatataccttacatggcttgttgatatttttcatcctagaccaaattcaagagggacaaattgcccaaatagagtatggaaacacgctgaaaaaaattggcctccgaatgaatttcttggaaccgacgaagaacttgatttctattttactaagttagataaacgaatgttaagaaaagaagggattggactagcaacagagcttttttatagcagtgaacgattagcagaataccgaggtaagaaaggtaatcataaagttgcgataaaatataaccgcgaaaatatgggctttatatgggttcttgatgaagatacagaatcttatttcaaagtccctgctattgattatgaatatgcgagtacagtaactttatggatgcataaaaaaaacctaaaaataaaacaagaactcaatattaccgaacataacttagactctgaaattgatgctgaattaagaattgatgaaattgttgatcaatctattcaaaagaaaaaaacaacaataacaaataaacgtcgtgctgctcgttatcaagaaaacgaacaaatggctgctaatgctcgacaacctaaagaaaaaaaatctgctaataatcaaaagacatctactaaaaatattgaaaaagaagatagttccggatgggatattgattatgtataggatctaaattatggatgacaacattacaagaattaccaaagcaaaaaaagcgtttgtatctacgcctgatgtagctgctatcataaacaatatagatcgatgcagaaggctctctaaatttggggcagaaccatcgtgtatgatggtatatggcgcatctggcgttggtaaaacctcaattataagaaaatacctaaaagcgaatgataaagactcaacagcacgacaagatattgtccctgttgtttatatcgaattaccagagaatgcaaaacctgtagatgccgctcgtgaactcctgctctaccttgaagatcccttagctctttatgaatcagacttagctattttaacaaaacgaatagtagatttagtaccaacaatgaaaatagagcttattatcattgatgaatttcaacacttagtagaaaaatcttcaaatagaatactctcaagagttggtgactggttaaagatgttaataaataagacaaaatgtcctgtcattctttttggtatgccctattcaaaagtagtcttggcagcaaacagtcagctgagaagccgcttttcgatacagtttgaattaaaaccatttagttatatcaataattatggcatttatgctggttttctcagacgtttagatgaagccttaccttttgatcaattatcaaaccttgcatcagaacctatagcaaaaaaaatctatgcattttcgcaaggaaatatgcgttcacttcgtaatttagtctttcatgctgcggtaaatgcaatcgaaaacgacaataactgcatcagtaaaaacgactgggaatttgcctctaatttgacatctggcaataaactctcaacatggaaaaacccttttgctcaaggcgtcaagatcacagatagaatgttgcaagaccaacctaatgacttaggttgggaagattatatgcgcaacaatagaggaaaaagaaaacctttcgatgagagtaagatctttagctaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1624 - DNA, 11867 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctggaaatagtacagcgcggctgaaatcatcattaaagcggtgaactgccgagtaggtagctggaaattagcgaattccgagcgaaggagatatacatatgcattttttagttcaaacaaaactttatcctgatgaggctcttgaaagctatttgctaaggcttgctagggataactcatacgatggctatagtgagcttgctgatattttatggcaatggcttgtagagcaagatcatgatcttgaaggtgcgttgccgttagagctgggtaaagttgatgtttatcatgctaggcaagcgagtagctttagaataagagcgctcaagttggtagctcaattagctgatgtaaacgctggtaatattcttgcgcttgcatggcggcgcagtaattttaaatttggcaacttagtagcagtaagccgtaatgagcagacaattcctcttgagttacttcgcactgataatatacctgtttgcattgaatgcttgtttgaatcttcttacgttccttttcattggcatttaaagccctataagacgtgccataagcataaatcacaattaactacacattgtaaggaatgccataacttaattgattacagagcttctgaggagtttttagagtgcagttgtggttgtaaactaaccaatagtgaacagttaaacgatgcagactttaaaattgcatttgcgcttgcaagtagtaacagccataaaatagtggggttaatatcttggtttgcgaaggttaagcaacttgatgtaagcgatgctgactttaaccgtacttttgttgattactttagtacttggcctgaaagccttactactgaattagatttactcacaaacaatgcgcgcctcaagcaacttaacccttttaataaaactaagttcaactctgtttatggaaatgtgatccgtgatggtcaaatagctgcaacaagtaaccgtaaaaacaaagtacttgatgaactaattaaatattttgttgaattagttgatagtaatcctaaaactaaacatccaaatattgcagatttactgctttgtacttttgataccgcagtattattaaacaccaccacagagcaagtttataggcttcatcaagaaggctttttaaactgcgcttacccacaaaaaaagcacgaacagctcagagctgatagtcatgttttttatttacgccaagtgattgagctacagcaagcattcgcagctgaaacgcctcaaacaaaaaaacaatttatagcgccgtggtaacttatgaacttacaagatgcatttgcgattgaatcacttaaggaaaaaaccacagcacttagaaagttgtttactccatatatgtctcatgttgcggtagatggctttgaagaacaagcgctgactgtgctcattaacctagtttataaacgaagtgagattgatgatttaacaagtacaagaaccgctaaaagtgtattacgtgatgaagtgttactgagtaaatgtattaacgaagttaaatggtttcatactcataatttaaaatatcctgatatacgcgtaagccatcaacgtttaattagtaaggtagtaagtgaagatattgcgggtatttgtagccggtcattacctttaagttttggatggtcgcacaacagtgctgaaattaatcatgcaaagttatttttaacctcatttacttggcaaggtgaagtaacttgtttagcaaatttactaataaatgaggagcctgtttggattaatttaataaggacatacgggtttactaaaaaggcggttttaggcatcgcgggtaaaataaaacagcttttgccagtggcagaactcccattagaagtaagctctttttcaccacaattacaaatgccatttcagcaaagctaccttgcggttacgcctgtagtaagtcacgcaatgctggctaaaattcagcaattaacaacagatcgtaagttaaattttggtttagttgagcactcaagacctgccaatgttggcgatttagcaagctcagtaggtggtaatattagagtgctgcgttactttcctaaaacatattcaaaggctgttaactgctctgaagtattcaataatgatagtgagaaagcatttaaaattcgtgcgctattaaacagtcaatttcaacaggcgcttttggtattggtcggtattaaacagtttaatacgttaaggcaaaagcgattagcgcgagtagcggctattaggcaagtacgtgttagcttgcagttgtggctggataacattctggaagctaaaaataacgctcaagggcaagcctaccctgagtgggcaaagcattacttagatcagagtattactaactgcattagccaatttagtaacgtactaaatgagagccttggtaatttaagtaagctcaaacgctttgcgtatcaccctaatttaatgggggtgtttaaaacgcagttaaactatgtgtttactcactgtattcctgatgaagaaacattaaatgatgagcaaatagtgtatgtgcattgccaagatatgcgagtgtttgatgctgaggcaatggctaatccgtatattcaaggtatgccgtcacttacagctttaaatgggcttgctcataactttgagcgtaagctaaaaaattttatagacccttcaattaagtgtattggtagtgccattaacattgaaagttatcaactacatacaggtaaaccattacctgaaccaagtaagttaaaacaagttgctggccgtagtcatgtcataagatcaggaattatcgataaacctaaatgcgatataacactcgatttagtctttaggctttttgtaccaaacattaagctgttagataagttaaatagtcagcttgtgaaacccgcactaccatctatgtttgcaggcgggactatgcatccaccttcgttataccaaaatattgactggtgccatttacatactaaaccaagtgagctgtttaaaaatataaaggcaaaatcgttaaatggcagttggttgtacccttcaaaaaaagtagtcaaaagttttgaacagttgattgatgcgcttaacggtaactttaatttaagacctgctgccattggttttgctgcgcttgaagaacccataaagcgagatgtagccttacatgaataccattgttatgctgagcccgtaattgggcttttagagtgtgttagcaatacatcagttaagtacgcaggggctaagcagttcttccatgacgcattttgggttatggatgttcaaaaagagtctatgcttatgaaaaagtctaagtttgagtatgaataatgcaattacctcggcatttaagttacacgcgttcgctttcacccagtaaagcggtatttttttataaaacatcggagtctgattttgaaccgctgcaaatagagcaaaataagcttgttgggcaaaagtcagggtttggcgatgcgtatcaaaagcaaaatgtggctaaaaatttagcgccacaagatctagcgtttggaaacccacaaacgattgatgtgtgctacgtacctccagcagtaaatgagctattttgccgtttttcactcagggttgaggctaatagcaatgaaccacacgtttgtgatgaccctaaagttatttattggttaaaacggttttttgaaacctacaaaaaacacaatggtcttaatgaagttgcaactcgctatgctaaaaatatactgatggggaactggctttggcgtaaccgccaatcaccaaatgttgatattgaaatccttactgaacatgcagccccgatcattgttgaaggtgcacaaaaactaaaatggcaaggcaactggcaaaacaatcaaacagcattaataacattatcagaagctattcaagaagggcttagcaatcctcaaaattattgttatttagatataaccgcaaaaattaaaaatgcatttagccaagaggttcaccctagtcaaaagtttgtagacaatgttgaacaaggcatgtcatctaaacaacttgcatacactcaagtcggcgataaaaaagcagccagtttaaactcacaaaaagtaggggctgcgattcaaactattgatgattggtatgagggaggttacaaacctttacgcactcacgagtatggtgcagataagcaaatattagttgcacatagaacgcctaagagccattcagacttttattcattacttccgcgcattgccttgcatattaagcacatggaaaagcatggtttagagcaaagtgaagaatcaaacgcagttcactttattgcagcagtgttgatcaaaggcggcttgttccaaaggagtaaggcatgaagcgctattattttactattacttatttacctaaaaattgtgatgtaagcctccttgcagggcgttgtatcggcatattgcatgggtttatgagttcgcgtgaaattagtaatataggtgtgtgttttcctaaatggaatgagcaagagataggtaatgaattggcgtttgtatcgacagataaaaagcaattaaccaatctatctcagcaaagctattttgagatgatggctcaggataaattatttggcttatcaaaaatactcgaagtaccaacaaaccaaaatgaggttatgtttattcgcaaccaatcagtagctaaggcttttgttggcgaaaagcaaagacgtttaaaacgcgctaaaaaacgagctgaagccagaggtgaagtttataatcctgaatatcaatttgaggcaaaagacataggccattttcattcaatacctgtatcaagcaaagccaacggccaaagttatgttctgcatatacaaaaaattgaaaatactaatgcgacagaaaatcaatttaataattatggctttgctacaaatcaaacatttcaaggtacggttccttctttgaatacccaataacctttaataaggagatatagcatgtacagaagaaaactcaaacactcccgtgttaaaaaccttcataaatttgctagtcaaaaaaataaatctacctgtttagttgaatcctctttagagtttgatgcctgttttcattttgaattttcaccatcaatagccgcatttgaggcacaaccactaggttatgaatatgagtttgataaccgtatttgccgttacacacctgactttttacttacccacacagacggcacgcaaaaatttatagaagtaaaaccgcaaagcaaaattgctgacgaggactttcgtgcacgttttattgaaaagcaaaccatcgctaaacaagatggacgcgacttaatactggttactgataaacaaatccgtgtatacccaacactcaataacttaaaacttttacatcgctattctggttttcagtctttaacagagctgcaagcatcggtgctcgagcttgttaagcaatacggctctattaaagtgggccagttagttaactttttaaaagtaactgccggtgagctacttgctactgtgctacgcttattatcactagggcagttatttgccgacttaactacaaatgaaatatcaatagaaacagcaatttggtctaacaatgtttaatgacggtttgtttgatgatgagtttaaccagccattaccaaaagtagaaaccaaactacctcaaaattacgccaaagatttacaagcccttcctgaaaaaattaaaaatacaacatttgctaaacttaaatatattcaatggcttgaggctaatattcaaggtggctggacacaaaaaaaccttgagcctttattgaaagtaatgcctgaagttgagggtgaaaaaaagcctagctggagaacagctgcacgatggtatagcgcttatacaaatgcagataaaaatatcatggcgctaataccaagccatcaaaaaaagggtaacagggagcgcgatacagccaccgataagttttttgaaaaagcacttgagcgttacttagtaaaagaaaagccatcagtggcttctgcttacaagtattacgcagacttagttatcattgaaaacgacagcgttgtgggcagtgttttaaagcctttaacatacaaagcgtttaaaaatagaatcgataatttaccgcaatacgacgtgatggtttctcgctatggtaagcgtcttgctgatattgcttttaataaagtagaagggcatacacggcctacccgagtactcgaaaaagttgaaattgaccatacaccgcttgatcttattttattagatgatgagctacatatcccgcttggtaggccaacacttaccatgttagtcgatgtgtatagccattgtattgttggcttctactttagcttcagcgagcctagctatgatgcagtaaggcgagcaatgctaaatgcaatgaaacctaaaagtgatgtggcaaaactatacccagatacgataaatgagtggaaatgtgctggcaaaattgaaactctcgttgttgataatggcgctgaattttggagtaacagccttgaacttgcttgtgaagaaattggtattaatactcaatataaccctgttgcaaagccgtggttaaaaccctttgtagaacgtatgtttggcacaattaacactgaattattagaccctgttcctggtaaaaccttttctaacattttacaaaagcatgaatacaatcccaaaaaagatgcaatcatgcgctttacaacctttatgcagctattccataaatgggtagtagacgtttaccatcaagatgccgatagccgctttaagtacatacctagccaactatgggagcaaggctttaatacgttaccgccaacagtgctgagtaatgctgatcttcaacaattagatgttgtgctcagtatttcaaaccatagggtgcttcgtaaaggtggaatacggctagaaaatttaagctacgacagtactgaactagccaactatagaaaacagtttagccataaagtatctcaagaagttttaattaaattaaaccccgatgatatttcttatatatatgtttacctcgataagctagagcattacataaaagtgccatgcatagatccaaacggttacacccaaaatttaagtttgaatcagcataaaataaatatacgtattcatcgcgattttatttccggatctatcgataatgtaggcttagcaaaagcgcgtatgtttattcataataaaattcaaaacgagtttgaagagttaaaaaatgcaccaaaacactcaaaagtaaaagggggtaaagcattagctaagcatcaaaatgtaagtagtgactcacaaaaatcaatagctcagagcgagccattagaacccaaaaaggttacacctaaagagcaaccaacagatagctgggatgactttatttcagacctagatggattttaattatgctgaccgataaacaaaaagcaaaacttaatgaatttcgcgatgtatttattgaatacccaataataactactgtatttaacgactttgacagattaagacttggtaaaggattagcgggcgaaaagccctgcatgctgttaaatggcgatacaggcacaggtaaaacagcactaataaaacagtataaagaacgccatttaccgcaatttattaatggagtgatgaaccaccctgtattagtaagccgcatacctagtaacccgacactagaatctactttagccgagcttcttaaagacttagggcaagtaggtagtacagagcgcaagctgagaataaacggtacgcggttaacgacatcattaataaaatgcctaaaaacgtgtggcacagagcttataattattgatgagtttcaagagctgattgagcacaaccaaggtaaaaagcgccgcgagattgctaatcgattaaaatacattaacgatgaagcgggtgtatcgattgtattggtgggtatgccgtgggcagaaaaaatagcagacgaaccccagtggtcatcgcgtttattagtaaggcggcagctgccttattttaaattatcagaaaacccaaagcattttgtacagttaataattggcctagctaaccgtatgccattcaccgaaaagccaaaattaagtgagcaagcaacagtatttgctttgttctcattgtcaaaaggctgttttagaactcttaaatactttttagatgatgccgtactttatgcattaatggataacgcgaaaaccctcacaaccaagcatctagttaaagcatttggagtactgtttcctgatgtaccaaacctatttaccttgcccgttgcagaaattacagcaagtgaagttgagcgctattcactttataaacttgaaagcgcccaagatgaagatccgtttatagcgactaagtttactgaccaaatgccgattagtcagttgttgaggaagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1625 - DNA, 11896 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggcagctgaaaagtacagcgcggctgaaatcatcattaaagcggtgaactgccgagtaggcagctgaaatagcgaattccgagcgaaggagatttacatatgcactttttagttcaaaccaagccctttagggatgaaaccctagaaagctacttattacgtttaacgcgagataacgcttataccgactaccatgagctggccgatattatttggcagagattggttgagtgtgaccatgagttagaaggggcatttccgctagaactgaaaactgccaatctataccacgccagccaatcaagctgttttcgcgtcagggcgttcaagctcgttgcgcagtgggctgctctggagccgcttgaacttattcgcttgtcctggctgcgaagcaatactcagtttgggcatttatcggcgcttattcgcgatcagttgctcattccccgaacgctcctaagagagagtcacatcccggtgtgcctaagttgtttaaaggaagagggctacattccctattattggcatttaaagccctacaaggcctgtcacaagcacaaaatgcaattacagtctcattgtgctgagtgtggcgaactaatcgattacagagcgtctgagcggttctctcagtgcaactgtggtgcaaagctaaagactacagctcctgcaagtgaagcggacatagcggttagtgaagggctcagcggtgcggatgcgcacgatttggtgggtaagttgacatggtttgcttaccagtacggccaagaccaagagcacgccagcttcaatgaggctttcatcgcttatttcaaatattggcctgataactttttcgctgaactcgatgaaaaagcatctagggcacgagaaaaacagctaaggccattcaatcatacaaaatttgatagtgtttttggtgatgtgatcaaagtcagcaaagtagccgggcccaatgtcttgagaacgaatattatcgttgattcattactggagtttttcagtgacctagttgagaagaacccaaaacaaaagcacccaaatatcgcagacttgctggtaaatagttcggatgccgcaactttgatcggtacgaccttggagcaggtgtttaggctataccaagaggggcagttgacttgttgcgagaggttgaacaagaacgaacgtttgcagccagacaggtgtgttttctacttgcgtcaggtagttgaattggcgcaatcacaaggacgctatgtcggtgacttcaaaaatcaacttatcacgccttggtgaattatggacttagctgaagcattggcaatcaaatctgtgcgtgagaaatctgatgcgctgcgaaaactttttgctccatacgcttcatccgttgcggttgacggatatgagcagcaggtggctaccgtgctaatcaacttggtttacaagcgcaatgaacaaattgatctggcaagcatcaaagcggcgaaagatgtgcttaaggatacagagctaatggcgaagtgtatcagtgaggtgaaatggtttcacacccataacctgaaatatcccgatattcgagtcagtcaccaacgcttgattgcacaagtaatcgataaggatattccagctatcaccagcgcttctttacctaaattgctgggctggtcccacaacagtgccgagatcaatcatgcaaaactgtttttgacctcatttaagtggcagggcgaagtaaataatctagcgggtgttttggttgacgaacatcccgcttggatagaagcgatgagaaacttgggtttaaccaaaaagtccgtaatggcattagctacgcatatccgagagttattacctgccactgacttgccgggcgaggtcagcgagttcacccctcagttgatgatgccctatggaaaagactacctcagtgtttctcctgtgctgagccatgcaatgctggtcagggttcagcaactggctcgggataaagtagtgaattggggagtggttgaacatacacgacctgcaaatgttggtgatttacctagttccttgggtggtaatgtacgcgtgctcaggtattttcctgcaacatcgctaaaaggcagcttaggagaatatatagaaaacgacccgaacgaaagactattcaagcataaggtactaacgagcaaaagttttaaaacgtcacttattattttgactggtaaatcagtttataacaccttgaggcagaaacgattagcgcgtattgctgcgatacgtcaattacgaagtactttgatgcactggttagataaaattatagagtttcaaaataatggcaaccacaatcttgtgccagagcctatgaagtcgttcatagaaaatttgaaaccgaatcttaatggtgtagtttgcgagttaagtggcttgttgaatgagcagttgtcctcccatcactcattgaagaaatttgcataccatcctgacttaatgtcggtattgaaacgccagctgcaatatgtgctaacgcacggggaaacggtagacgaaaccttagttgattctcaaattttgtacgttcactgtaaagggctgcgaatatttgatgctgagggaatgccaaatccttatttgcagggcattccgtcgttaaccgcattggcgggagttgcacataaatttcagcgcaaacttcagtctattgttgacccttctatcgagtgtattggttcggctatattcgtacacagctatcaattacataccggcaagccattgcctgagcagaatcagcttaaaactaaccaaggaataacctcggcaaaaagaccggggatagttgataagcccaaatgtgatatgacgattgatttggtatttcggctttttgtgcctcacgagagcactcggactcaattaaccgacaatatgtttaaggcagctttccctacctcttttgctggcggcaccatgcacccgccatcgctgtatgaaaccgtcgagtggtgccaggcattcaccagcccaacccagctttttggagaactgagtttgctgccgtcgagaggttgttggctttatccttcaaaacaccaggtgagaacgttcgaggacatggtggaattactagacgcagatccaaatcaacggcccgctgggttagggtttgcgtcactggaacagccgacccagaggaaagaggcgttaggatctaagcattgttatgttgagcccgcgattggtttattagaatgcgttaacccaattactacacgcatgggaggagcaaaggcattctttcataatgccttctgggtaataggagtcgagaaaacgtctatgcttatgaaaaaagccaagtttgagtacactcaatgcgactcccgcgacacctaagttatacgcgttccttgtctccgggcaaggccgtattcttttatcaaactcctgaatccgattttgaaccattgcagatagagcagaacaagcttattgggcagaaatccggttttaccgatgcatatcaaaagctcggagaacccaaaagccttgcaccccaagatctagcttttgggaatccacagaccatagacgtatgctatgtgccaccgactgtgaatgagattttttgccgtttttctctgcgggtagaggcgaacagtgttgaaccatacgtttgcgatgaccgtaaagtgagctattggctgaagcgctttgtcgaaacctacaaggagcatggtggttttaaagaattagcctcacgttatgcgaaaaacatactgatgggaaattggttatggcgtaataagcaatcaccgggctttgatgttgaagtgctcacggaacactcagaaccaatcgtgattgagggtgctcaaaggttaaaatggaatggcgtttggggaaacgatgaggctgcattagcaaccttgaccgaggctattgaaaatggtttggctaatccacaggcctattgctatttggacattaccagcagaattaaaacggccttttgccaggagatccaccccagtcagaagtttgtagacaatgttgaacaaggaatgtcatccaagcaactagcctacactcaggtggatggtaaacaagttgcaagtttgaatgcgcaaaaagttggcgctgcaattcaaaccatagacgactggtacacagaagatctcaagcgtttgcgtattcacgaatacggtgcagacaagcaggtattagttgcgcatagaacgccaaagaatggtttggatttttactctctacttccaaaggtcgctgtttatatcaggcacatggagagggatggtctggaagatgatgaagagtctaagcacattcactatctggcatcgatcctgttgaaaggtggtttattccaaaggtctaaaggatgaagcgcagctatttcacagtcacctatctcccaattaattgcgattactcgctgcttgctggcaggtgtattggcattttgcatggctatttaagcagatttgaacttgatggaataggtgtgagttttcccaaatggaacgaggagactgtaggtaatcaaatcgcatttgtctccgagagcgagagccatttacagacactacggcagcaaaactactttcagatgatgagccatgacggcctattcaaattatctgtgactagaacagttccagagcaggttgatgaaattcagtttgtgcgcaaccagtccatatccaaagcctttgtcggcgaaagacgcagaagaatggtaagggcaaagctaagagctgaagcccgaggggaagagtacaacccgatttatgaatttgagcccacagaaatagagcattttcactcaataccgatcacaagtaaaagcaataacaatgagtttgtattacatatccagcggcgggaatgttctggtacagcgggtggatttaataaatacggttttgccacaaacgaacatcacctcggtacagtaccgagcctttctggccttttaattagttaacctttaataaggagatatagcatgtatagacgcaatcccaagtcatccagagtcaaacaccaattcaaattcgctagtcaaaagagcaagaacacttgtttcgcagaatcagcattagagttcgatgcttgtttccactttgagtattcctcagcgattgtcgcgttcgagactcagcctcttggctttaagtacgactttgaaggccgtacttgcccatatacacctgattttctattaactcacagcgatggcacgcaaaagtatatcgagataaagccggtaaaagagcttgctaaggatgagtttcggcaacgctttgagcagaagcagttggcatcaaagcaactgggtattgagcttatattggtgacagataagcaaattcgagtatttcctgttttagataatctgaagctattacatcgttactccggattccaggtattgactgaattacatacggttgtggtcgggttagtaaaaagtactgggttagtgaaggtcgcgcagcttgtaaattacctaaaggtttctgccggagaagttttatccatcgttgcaaggctgttgtgcatcgggcagttggcaacagatctcactacagatgcactttcattagactctgtaatttgggcctcagatgaacagtaaaagtctggggttgtttgacgatgagttccagcatccgataccccaagtagaagcaccaaaaagcaccaaagctgaaaaagatctcagtgcctacccgcaagaaatacagcagacaacctatgcacggcttaaatacattcggtggcttaaagagcgtatagttgggggctggactgagaaaaaccttgcgccactcataaacgaaatgcctaaagtcgaaggtgcagataaacctaactggcgtactgcggctcgttggtttaaatcttattctgaatctgatgaatccatttttgctcttattcccaaacaccaaaagaaagggaaaagaacacaaagaacagacacagacaagttctttgaaaaagcacttgaacgatttttggtaaaagaaaggccttctgttagctcagcttatcaatattacaaagacttagtggtaatagagaacgaaaaagtaataggtgaagatttaaggcctttaacgtacaaggcgtttaagaaccgaatagataaattaccacattatgaagtattacgagcccgctatggtaaacgtatcgcagatttagcttacaacaaagtagagagccacaagaggccgacacgagtgttagaaagggtagaggtagatcacactccattagacttaattttattggatgatgagttacaaataccgctaggacggccaaccctaaccattttaattgatgtctatagccattgtattgtcgggttttaccttggtttcaatgatcctagttacgatgcaattcggcgggcgatgctaaacgcaatgaaacccaaaaactggataaaagagcagtatccagatataacccacgattggcattgttgcggaaagattgaaaccctcgtagtagacaatggtgttgaattttggagtaatagttttgagtctgcgtgcgcgcagatcggcattagtttgcaatacaacccagttggcaagccctggcttaaaccatttgtggagcgaatatttggagtaataaatacccagttattggaccctattccaggaaaaaccttttcaaatatgatgaaaaaggagggctatgacccaaataaagacgccatcatgcgctttagcgcgtttatggaagtattccaccactggattatagacgtctatcaccaagaagctgacagccgctttagttacattcccgcccttgagtgggatagggggtacgagcagctcccgccagcgccattatctagtgacgacatccagcgattggaaatcgtgctgggtataagcacttggcggcatatccgtaagggcggtattcattttgaaaatttacgttacgacagtaacgaacttgctgattacagaaagcgctttagccccaaggcttcagtaaaactgatgttgaaggtgaatccagaggacctttctagggtctatgcctttttacctgagttagatcactacattgaagtgctatgtatcgatcctaatggttatacagcgggcttgagtctacaccaacataaggtcaatgttcgcttacagcgtgattttatcggttctcacatggatgttgctgctctcgctagggcgaggatgctaattcacgaaaaaattcaaaatgaagttgagttgttagccaactcgacaaaaaaacctaaagcaaggggcggtaaggcattggccaaatatcaaaatgtcgccagtgacaatcttgtatcggtgaagcctagttcacccactaaaaagccacctgagaaagtagaaacagaggaagcgcagaataaaggtgattgggacgacttcgtgtcagatctcgagggcttctgattatgctctcagagatacaaacgcagcgcctaaatgaatttattgacgtattcattgaatacccattaatgactacaatcctcaatgattttgaacgattaaggacgggtcaaaaacttgccggcgagaagcagtgtatgttgctaacgggtgacacaggctgtgggaaatcttctgtaattaaccactacaagaataaacatccggcatgtcacattgacggtgtttaccatcacccagtattagtttcccgcatccccagccgtcccacgttagaatcaaccatagcgcagctacttagcgaccttggtcaggtaggagctgcaaaaaggaaattaaaacgcaatgatgccaatcttaccgattcattaattactaatttaaaatcgtgtggcactgaactcatcattattaatgaatttcaggaactagtggaatccaatcaagggaaaaagcgcaacgaaattgcaaataggctcaaatacctaaacgaagaggcgggtattccgatcgttttggtaggtatgccttgggccgaacaaatagccgaggagcctcagtggtcctccagattgatggttagacgctttataccttactttaaactctcaaaagatttaacactgttcgttcgggtattgatgggcttggctacacgtatgccgtttcgtgataagccccgtttgcaagagcaagatattgtctatgccttgtttgcggtatcgaaaggctgtttccgtaccttgaagtattttctgaatgaagctgtaaaacaggctttgatgtacggctcagagacgttaaccaagcagcatctcagcgccgcatttgaagtgttttacccgggtatagaggacccgtttaagctatcggtggatgagataacggcctgtgaggtagagagctactcggtatatcacaccgacagtagctcggataacgaggcgcataatcggacgaggtttacggaaaaaatgcctatcaaccagttgctaaaaaaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1626 - DNA, 12025 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgacctgccggataggcagctgagaaaagtacagcgcggctgaaatcatcattaaagcggtgacctgccggataggcagctgagaaatagcgaattccgagcgaaggagatattcatatgtttctcattcatcccgaaaaacactaccaagatgagtcccttgaaagttttttgattcggctttgtgagtgtaatggctttgagtcgtttcggttgttgagtggtgcgctatgggaatggctcgttgataacgaccatcaagcagcaggggcgctttcccgtcagttgtgtgagataaacctttatcatgccaagcattccagtggttttagagtacgagcttttgagctactagattcattgtttaaggggaacgctagaccattgatgcaacatgcgctgttgcattcagccgtaactttttcccccaacttaacgtcagtctttcgggctggtatacatatccctcgctgttttcttcggcaaagttacacgcctgtctgtccggcatgtttaacggaagctccatacattcgccaatattggcacttaaagccttatcagagctgtcatcgtcatggtgttgccatgttgttccattgcccatcatgcagtgccgttctgaattatcaagatactgagcaaatcgagacttgtagttgtgggtttgatcttcgtgatgcagggacaaatgttgcttcatcagagcaaattgcaatcagccagcttgttgttgaaggggaaatgcaaaatgctctctcaattagtcattggttaggcgcactactttggttttatcggtacaagcagtctcagctttctctcaatgtggtcaaagaacctgagtttggccgggcagttgaatatttttcacagtggcccaatgcgtttgtgcgtgatttgcatgagttggctacacaggctgaaatgaaacttgtcagaggatttaatcacacgcgcttttcggaggtatttggcgatctcctgagttcatcacgtaaattgccatcgagcgatactcaacaaaatttcatcctcaaggccgtgatcgattttcttcagcagttggtgcgagataacccgaaagccaaagagacgaatattgctgatgtgaagttgacggtcgtggaggccgcagccctgttaacaacttcgacagaacaagtgtatcggctttatgaagaagggtacttgcaatcatctgtgcgttttaaactgcattcaaagttatcgcctaatgatgcggtgttttttctacggcatgttgtggagttacgtatggctgggatggcatcggattacagtgctaatgatgtttatcttccatcatggtgagatcaatgcatttatcggagttactactcgttcaagatacagaagaacgcaatcagttattgagaaaagcacttgcgccttatacctgtctcgttgacgtaacaggctatgaacgccagctattgatgattgctattaatataacggtgccgagaaaagatgtagacgatgttttggataagaagctggccaaatcattgctgaccaatacaaagcaccttcaacgttgtattgatgaagtgcaatggttccatacccacaatgtgaaataccctgattctcgggtaaaggggcaacgcattatctcccttaagcaagatgaggttgacggggttttgtgtagtgccaatcttccttcatcattgggttgggcgcataacagttctcaggttaatcctgctaaatttttctctattcgctttatttggcaaggccgagcaatgtcactgcttgaaaccgtgattgatgctccttctgaatggaaggtggcatttcgatctttagggataataaaaaaacagttatcggagttcagggaaatattttcgacctactatacctctagtcagatcccatctgaagtcagtgattattcaacgcaaatacgcgtgccatatcagggctattattgtgctctaacccctgtcatcagtcacagcgttcaatcgaaaatccaaaagatggcatttggccgaaaggtgaaatcgagcaatgtagaacatcatcatcccgcgagtgtgggaagtttggttgctgcgttaggggggaatattcgggtactggattatcctcctaatgttcgtcagaaaacatcagaggctttttcactgtaccgagcggtaagtgaaaaggaggtatttgatcactcgattattaaagagaagcgctttctggatgcattgagtcgcattgcgggagagaaccctacaccaacactgaggcagcgacgacaactgcgagtatctgcattacgctttgtacgaaagcagcttgccttatggctggctccgatgatggagtggcgagatagtattggtggggaatctcgtcattctcccattgaaacactagaagaacagttgctttacctgcccattgcacacttaccggatgtccttagcgatttaaacacacgttttcatcaagcattgcaataccatcgtcgaggggcgcgttatgcctaccatccagaggtcttgtttccgattaaacagcagttgaaatggctgcttcgttatatggcaaatcaacaagatgcacttataacgcctgagccaaattgtgtgtacctgcatcttcagcaacttgtggttcatgacgcttcacttctgtctaacccttatgtttcaggaatacctgccttaacagcgttggggggattgatgcataactatcagagaagattgagtgcattgatggagtgtgaatgcttaattcaacgaggtgcttggtttattgcccactatcatcagcagaagatcaagaaacttcccgaaccggataaggtgaggtatctgaagaaaagatcagatgttcagcgaccaggtattaccgatggaaaatatggtgacttaaccatgaatttggtgctggaattacagttacccgagtcagtatcaatacctgaactatcccttttacaagccgcgttcccatcgcgttttgcaggcgggacgcttcaccctccatcattgtttgagcaaacagattggttatcggtttactctaaccaaagtgaattgttttctgttttagctcgcttacctcgaagtgggtgttgggtttatcctgatgataaaggtgtgagttcgtttgatgaactggcttctcgtttggataatgaccctgacttaaagcctgttggtctgggttttatcccactggaagaacctcattgccgagtagggagtatcgcgccttaccattgttatgtcgaaccatgcattggtgttgttcggtgtatgaaccccattaacgttaggctctcaggtagccagcaattctatcagtcggctttttggcactttgatattgcaaatgacgctatgcttatgaaaaaggcaacatgaggtcatgtgaaatgcaaatttgccgccacttaaactatgttcgctcattatcaccgggaaaggcggtgttttactatcaaacacccgagtctgattttgtaccgattcaggtagaaacgaaccgaattagagcagcaaaatccggatttactgaagcgtatgataagaaccaaaatctcaaaaatgttgccccgcaagatctcgcttacagtaatcctcagtgcattgatgcttgttatgtcccgccgaatatttcagagatacattgccgtttttcactcagagtagaagctaactctcttcagcctgatagctgtgaagatcagaaagtaaggcgttatcttattcaattagcatcaatttatgcgcaagtgggcggctaccaagaattggcaaagcgttactgtaaaaatattctgatgggtacatggttatggcgcaataatcacacgttaggaactcggattgatgtgattacgtcgagtggccgctgttacgccattgacgatgcccgttatttggattggattgattggccggaagaagaacaagtaatgctgaatgacttggcttcagaaatggcggcggcattgtgtgaacccaaacaattttggtttgcagacataaaagcgacgttgaaaacggggttttgtcaggagcttcatcccagccagaagtttactgatagtcatgaacaaggagagtcatctaaacagtacgccacggtagaatgtcctaatggtattcaagctgcatgttttcatgccgagaaggttggggcggcgctacatctgattgatgattggtgggatgaggttgcagataagaggctgcgaactcatgaatacggggcagatcgagactacctgatcgctcgccgccacccaatgaagaagcaagacttttattcgttactgacactaactgctgtgtttatcaggcagcttaggaacgtcagggataaagggggggaaattccgcctcaagttcattacctaatggctgtgttgtgcaaagccggtatgtttcagcgaggtaaaagctgatggctaatcgtttttattttctgattcgttatatgccagaagatgtggatgaggggttattagctgggcgttgtattagtatcttgcatggtgtgttgtcctcggatcagaatgatattgatggcggtattggcgtggtttttccgcaatggagctgtacgtctttagggcggagtatcgcatttgtttccgataatcagcgacatttagaacagttaagccagcaacattactttgctgtgatgaagggggataacctctttgacatctcgcatatccaagcagtaccatcaggcttatcagaaatacgattcaaacgtaaccaaggaatcgcgaagtgctttgcaggtgaaaaacgtagaaggttagctagggcaaagcgtcgagcagaagcaagaggtgaagtctttaatccaaagcacggtatgtcagatcgtgaagtgagcctatttcacaaagcggttatgaccagtaaaagcacaggccaaaaatacttactgcatattcaaagagaaacagttacaggatcgagtgtgagtcagtattcgcaatatgggctggcaaccaacattgagtgcatgggcacggtgcctgatttaagtccgataataccctttttttgacctttaataaggagatatagcatgtaccgccgaaagctcaaacattcccgcgtaaaaaatctttttaagttcgtcagtgccaaaatgaatcaggctatgacggttgaatcctacttagagttcgatacctgctttcacctagaatattcatcatccatcatctcttttgcggctcagccggaaggtttcatctatcgtattgatggccgagattgctcttatacgccagattttcaaatacttgaaaatgaagaggtaaagtggattgaagtgaagcctttcgtgaaaactcaacgtccagattttcttcagcgttttaaagtgaaacaagaaaaagccttagcgcttggtgttcctctcattttggtgacagagaaacaaatcagggtgaatcccgtcttgaataatctcaagatactgcaccgttattcgggttttcagtcgcttacagatttacatatccgtcttttgtcattggttaaaacggtgggaaaaataagcgtgagtgatgcagcctgtcggttaggtattgatcaggggatgatggtgaaatcggcttttagcttggtgtcatccggtatgctaacggctgatttagtacatgatgaattgggtttacattccattgtttggagtgaacacaatggctaaagacatcagtaccggactttttcaagatgagatggcagttgcatccagcagtgagccagttgaagcattacccagttcaacggatgatttctttgaacgtgacctcgcttcttatcctgatgaaattcaaatagaagtcagacgtaggattgaataccttcaatggattgaaaagcaccttgtaggaggctggacacaaaaaaacttagacccactgattgaaaaagcagccagagaaatagactttcctcctccaaaatggcgagcattagcgaagtggtggagtgtctattcatcatctgggaaaatgttggcgtcattagtgcctaagcttcatcgtaaaggtaatcgaaatctaaaaataaccaatgaattatcattttttgatcgcgctgttgaacgttatttagtccccgaacgtccttctatttccgctgtttatcagtattacaccgatcttattcgcattgagaatcagcatcttgtcggcgagaaagttcaagccctctcatacaaaggcttctataaccgaataaagaagctgccagcttatgaggttgcagtagcaagacatggtaaatacctcgctgacatggagttcaacaagatcgatgcgcatcaaccacctagccgagtattggaaaaggttgaaatagaccattcaccattagatcttatcctacttgatgatgagctaaatattccgctaggacgcccttatctgacactactgattgatcagtacagtaaaagcattatgggttttcatttagggtttaaagaacccagctactattcggtaatgaaggccatccttaatgcgataaagcctaaagatgatattgcggagcgatttccaggtgttgtgcatgactggtattgtcagggcaagatggagtcactggttgttgataatggggcggaattttggagtaagagtcttgagcagtcctgccttgaagttggtattcatattcaatataaccccgttcgcaaaccttggttgaagccgttggtggagcgaatttttagaaccatcggcagcaagttgctagtgactattcccggaaagaccttctctaatattttagcgcgtgaagagtatgatccgcgaaaagatgcggtgatgcatttttcagtattcaatgaactgtttcataaatggattattgatgtgtatcactatgaatcggattcccgaaagcgtgcaattccttatgtgaaatggcaggaaggggttgtggtgatgccacccattagttatgagccggaagatctggaaaagctatctgtggttttagggatcaaagaattacgcaaacatcgacggggtggtattcaccttcatgggttacgctatgacagcgaagagttagcggattaccgccgaatgtactcgcgagacatcgacgtactcacgaaaactaaccctgatgatatttcaagcatttatgtctatttagagcataagcagcaatacttgaaagtgccatgcatcgaccctatcggttacacgaaaagcctatctctcactcagcatcatattaatcaacgcttgcatcgagatttcattgacagtcaactagacctagaagggttggctcgcgtcagaatgtatattcatgatcggattgaacaagaagcagacgagattaagaaccttaaccgagggaggcctcgacgtactacaaaaggtatggcgagattagctaaacataacggtgttgccagcgatgttcaaaccagttgtgtaccagaaacactaccggaactgtcgatgccagataaagggaaagaatccaaacagttgccggactctgatgaatgggatgatttcatatctgatctcgagccatattgatggatagtttgtctcctgaagatgaagcgaagtatcaggcgtttgttgatatttttgtcgagcagccgatagccacaatggttatggctgattttgaccgattgagatacaaccgacaatttggtggtgatcagcaatgtatgttactcacgggagatacgggttctgggaagtcttttttaatcaaagagtattgtcggcgtcttgctcaaaccaacccaatgaaacaagcattggtactttcaagtcgcatccccagtaaaccgactcttgaatccacgatcattgaattgctcaaagattttggccattttggtgcgacgtaccgaaaagggaaaagcaaagatcaatccttaaccgtctcattgattaaatgcttaaaggcatcttgcgtagaactcattatcattaatgagtttcaggagttggtagagtttaaaacagggcgagcattgaatgagatagcaacgcgcttgaagcacatcagtgaagaggcgacagtaccgattgtgttggttggcatgccctgggctgcgaagatagccaatgagccgcaatgggcgtcaagactgcttatcaggcgagaattaccatactttaaactctccgaagaaccagaacacttcatccggtttatcaaagggcttgccgccagaatgccttttaccgaactgccaaaactggataacaagcagacgatactggctctgttctctgcctctaacggccagactcggcgtttaaagcaattattaaatgaagccgttaaactggctttagttcagaatgcggtgacgttaaccaatgaacatttagcggatgttttccgtatgatattccctgccatccctaatccattcttagcgtcgatagagcaaatagaagggcaagaagtgagtttaccctctcattacgacagtggtgcagacaatgaatttgaagccattatcccgactcagtacacagatcgccttcctttatcgcaactattgcgtaaaagtagaaaaactaagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1627 - DNA, 12107 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgaataggcagctgaaaatagtacagcgcggctgaaatcatcattaaagcggtgaactgccgaataggcagctgaaaattagcgaattccgagcgaaggagatatacatatggcttttcttttttctcctaaagcgcgatcatttagtgatgagtcacttgagagttacctgctgcgagttgttgctgagaacttctttgattcctatcagcagctgagtttagccataagggaagagttacatgaacttgattttgaagctcatggcgcatttcctgtagaactaaaacgacttaatgtttatcacgctaagcacaatagccactttagaatgcgggcattaggcttacttgaatctctccttgatttgccgcctcatgagctacaaaaactagcactacttcgctcgaacaaaaggtttgtgggaggtatgtcggcagtgcatcgtaatggtgtagacattccattgagctttattcgttgcgctgatgaggacggtatcgaaagcctacctatttgccctcaatgcctgaaagaggagccctatattcgtcaggcttggcatattaagccgattgaagtgtgtgccaagcatgagtgtgaactgattcatcattgccctgattgccaacaacctatcagttacattgagaatgaatctattactcactgctcatgcggttttgagtttgccaccgcttcgagcgagaaagccgatagccaagcggttgtattgtcccgtagcttgtttgatggtgatgcattatctaacaatcctctgttatttatgggtacttcagtgactcatcgatttgccgctttgctttggtatctgaagcgtcatgttcaaaatatagagtgtaaattggatgagtctgtaaattactttgaggcttggcctgaaaacttttatcaagagttagatgagcttttagctggtgctgagctgaaacttattgatttgtttaatcgaacgtctttgagttttatttttggtgagttgattttacagtctcaatgtttattgccagaagataaaacaccacactttatcgatatggggttaatggaataccttggcaaattagttgagtcacatcctaagtctaaaaagcctaatgtggctgatatgttggtgtctgtgactgaaaccgcagttttgctctctaccagtcatgagcaagtgtatcggctttatcaagatggtgtgttaactgctggatttaaacaaaagattcgcactcgaatcgatcctcatattggtgtgttctatttaagacaagttattgagtacaaaacgagttttggtaacgataaacaagggatgtatttatcagcatggtagataaacttaagttccacgaattgctcgatattgacgacatctctgagcgtaatattgctttaaggcgagcatttactggctatacagtgccgatggatgtgacgggcaatgaggcctctgcgttaactattttacttaatctgacttaccctagaaaacgggttgatgatctacttgataaacggttagccaagcagacactcaatactgatgcacacctagatgccagtattgacgaagtgcaatggttacatacgcataatttaaagtatccagacatacgagtaagcaagcaaaggctgattacagcatctccgctatcacactctcatatattgagtagtgcaaactgcataagcaccttgggttggtcacatgacagtgccaaagtgaatttagcaaagttgttttcatgtcattttaattggcaagaccgtgtttgttgtcttgcaactttgttgtcagatcctcctaaaatttggaaagaggcttttcaagcgttaggcatgcttgtgaaggactttatgaatttgtgtggcaggattaaggcttcattgcctagctatgagagtcccagtcgtgtcgataaatattcgattcaagttcgcctgccttatcgagatggctatttggcgatcacaccagttgttagccatgcacttcaagctgaaatacaacaagctgcaatggctaagcagtgccgatacactaattttgagtttacacgtcctgcggctgttagtgagctgtcggcctctcttggtggtaacgtcaaagcgctgaattatccacctcggataggaaatgcagtgcatggattaagtgactcttggttattaaaatttcaagcaggtcaaacagtattaaaccaaggtgcgttatcacaacctcgatttaagagagccttagagggccttctatcaaatggttttgaactggcattgaagcaacgcaggctgcataaagtagcaagcatgaggcagataagagcaaccttgactgaatggttgtcaccattattagagtggcgtttagaggttgaagagaacaagaataatgttagcgaactcgcctgtattcatggctcatttgagtatcagtttttaactgcgcaaaaagaaaaccttgtcgggttactaaacccaatgtttagcctgttaaatacaatcttgtctaactcaaacacattacaaaaatatgccttccatcagcgtttgatgaggccactgaaatgtagtttgaaatggttgctcgataacctctcgaaagaatcgaatgcaatagattcagatgaggacaatcaacagcgttatttgtatttgaaaggcataagagtatttgatgcccaagcgttatctaacccttattgtgcaggtttaccttcattaacggctgtatggggcatggttcataactaccaacggcgattaaataaaaggctaggtactcagcttagattgacctcattttcatggtttattcgccagtactcatctgtagcgggtaaaaaactgcctgagtacggtatgcaagggcaaaaagaaaaccagtttagacgggctgggattgtagataacaaacattgtgatttagtgtttgatcttgtagtgcacattgatggctatgaagaggacttagatgcaatcgataattctacagatgctataaaagccagttttcctgcaacatttgccggaggtgtaatgcatcctccagagatcggctcagtcgatgagtggtgtgagctgtatcctagtgaaacatcactttattctaagctaaggcggcttcctgcatccggtaaatgggttatgccaactaggtatcaaatggatagccttgatgggttgcttcagctattgaagcttaatgtagcactctgcccagtcatgtcaggctatctgatgttaggaccccctgaaagccgcaaaaattcgttagagccattacattgttatgctgagcccgcgataggagtggttgagtgtgccactgctattgatataaggttgcaagggatgagtaacttttttagacgggctttttggatgctcgatataaaagagacttcaatgctaatgaaacggatttgaggatgctttatggagttatgtaatgttttaaagtacgaccgctctttgtacccaggtaaggcggttttcttctacaaaacagctgaaagtgactttgtccctcttgaggctgaaatcaatcgtattcgaggtcaaaaagcaggctttacagaagcctttactcctcagttcaaatccaaaaacttagcaccccaagatttagcccactgcaatccccttatccttgaagagtgttatgttccgccaaatgttgagtatatttattgtcgtttctcattgagagtacaagctaactctcttaaaccagctggttgcagcgaaccgacagtatttgctttacttgaagagttcgctgccatatttaaagcgtgtggcggttacaaagaactagctactcgatactgtaaaaacgtgctgttaggcacctggctctggcgtaaccaaaatacggggaactctcaaatagatattaaaactagcgctggtaattgctatcaaatagctaatactcgccaacttgcttgggacagtcgttggcctgccgatgctcagcaagtattggaagagttaagtgatgaggttcatcaagcgttaactgatcctactgtattttggcatgccaatatcaccgcaaaaattgaaacggctttctgccaagagatctatccaagccagtcttttggcgaaaaggcggcacagggtgaagcatcaaaacaatttgctaaagtgaagtgtgttgatggtcgttatgccgttagctttaattcggtaaaaatcggcgctgcactgcaattaatagatgattggtgggatgttgacgattccaagcgattacgtattcatgaatacggtgcagacaaagaattaggtgttgcgcgccgcgctcccgaatctaagcagagtttttattctctatttatcaatacagaactctatcttgcagagcttaatcaacagctcgctgaggatgaatattccattagcccaaatatttactatctgtttgcggtgttaataaagggcggcatgttccagaaaaaggctgaagctaaaagcaaatcaaaagccgaaacctccaccgctaaaataactcctgctaaggcctagtatgcatcgatattattttatggtgcgatttttacctgaacaagcaaacttagctctgttaatgggacgctgcatttcaatcatgcatggctttatttgtaagcatgacattcaagggcttggtgtgagttttccagcttggtctgatgcatcaataggcaatatgattgcttttgtccacacagatatagctgcattgaacgagttaaagctacaaggctattttcaagatatgcaggagtgtggcgtttttaaagtcgataatgttgaagcggttcctgatgattgcgtggaagttaggtttaagcgcaatcaaggtattgcaaaaatgtttgttggtgaagctaggagacgattaaaacgtctggagaaacgtgctctagcaagaggggaggtttttaatccaaataaaaacgatgagccgagagagttagattgctttcattgcatagcaataggaagcaccagtactgaacaggattttcttttgcatgttcaaaaagaaattgtacaaaagtacgaagaacctgagtttaatcaatatggattagctacaaataagttactgagagggacagttcctgaatttagtgaattttaacctttaataaggagatatagcatgtatattcgtaatttacgtaagccttcgcccaataaaaacgtctttaaattcgcgagtgcaaaagtgagcgaaacgataatgtgtgaaagtacattggagttcgatgcatgtttccaccatgaatataatgagacaatcgagacttttggcagccagcctaaagggttttattactgttttgaggggaaaaggttgccttatacgcctgatgcgttacttcactacattgatgggacgacaaagtttcatgaatataaaccttacagcaagacattcgaccctatttttagagcaaagtttgtagctaagaaagaggctgctcaggcactcggcactgagcttatacttgttactgataagcaaattcgtgtaaatccaatcttaaataatctcaaattgcttcatagatactccggaatctatggtgtgactgacatccagcgtgagttgctacagttgattcgacactcaggaaagattcagttagatgatgttgctgatgaatatgagctttcagtcggtgaaactcgctcgtttctttattcactaatcaataaaggcttgctagaggcagatctaactcaagatgaccttagctgtaatccatttgtttggtgtaatgcatgattgaatttaaagatgagtttacagagtctacatctgtcaaaaagcccgatacccctggtcaatacatcaagttagatgatgctgagatacttaaacgcgatcttgatacttttcctgactttcttaaagaaaaagcctttgataaatataaactaattagttttattgagcaggaaaactcagggggatggacgcaaaaaaagctagatccaattcttgataaactatttgaaggcaatagagataaacggcctaattggcgtaccgtggttcgttggcgtaagagttatatcgatagtaatggtgatttagcctctttggttgttaagcgccataaaatgggcaaccgaaagaaacgagtggaaggcgacgaggtattttttgagcgagcattatctcgtttcctagatgccaaaagaccgaaagtgacaacggcctaccagtactataaagatgccatcacgattgagaatgaaacaatcgtcgatggggaaatccctattatttcctataccgccttcaatcaaagaataaagtcactgccaccttatcctatagctgtcgctaggcatggtaagttcaaagctgatcagtggtttgcatattgttcttctcatataccaccaactcggattttagaacgggttgaaatagatcatactccacttgatttaatccttctcgatgatgaattacagctccctcttggaaggccctacctgactttaatcgttgatgtttttagtaattgtgttttaggttttcatttgagttataaagctccctcttatgtatcagcggctaaagctattgtgcatgcgataaagcctaaaactctgggtattgtgggaatagagcttcaaaatgattggccttgttatggcaaatttgaaaccttagttgttgataatggagctgagttttggtcaaagagtttagaccatgcttgtaaagaagctggtataaatattcaatataaccccgtgcgtaagccgtggttaaagccgtttgttgagcgtttctttggcatgattaaccaatattttttaaccgaactcccagggaaaacgttttcaaatattctcgagaaagaggactacaaacctgaaaaagacgccattatgcgtttttcagtatttgttgaagagtttcatcgctggattgttgatatttatcatcaggattcagactctcgtgatacgcgtattccaataaagcagtggcagcatggctttgatgtctatcctccattgcagatgagtgtggaagatgagaaacgttttaatgttctcatggggatcactgatgaaagaacattaactcgaaatggttttaaatttgaagagttgatgtatgactcaactgcattagcggattatcgtaagcactacccacaaactaaagacacaataaaaaagctgattaaaatagaccctgatgatctctctaatatccatgtttacctcgaagagttagagggctacctcaaagtaccttgtaccgatactacagggtatgccaatggtttgagtctgcatgagcataaagtgattaagaagattaaccgtgaaattatacgcgagagtaaagacaacttaggtttagccaaagctagaatggcaattcatgctcgtgtacaacaagagcaagaactctttaatgaatccaaaacgaaagctaaaatctccgcagtaaagaagcaagctcaactcgccgatattagtaacacaggtcaaggtactattaggcttgaaaacagtgacaccctttcagacataaccaacaaaccagagtctaatatcagtgacatcctcgataactgggatgataatatagaggggtttgaatgaataccttaaccgctcatcagatggagcagttgggcaggtttaatgattgttttgtcatgcatcctcaagctaaggtcattttcaatgattttgatgatctaaggttaaatcgaaactttcaatcagaccaacagtgcatgttgttgaccggagatacaggtgtaggtaaaagtcatctgattaacaactataaaaaacgagtgttagctagtcaaacatatagccgtacttcaatgccggtattagttacccggatctcaagtcataaaggtcttgatgcgactctgaggcagatgttaactgatttggaatcatttggcagccaacaacgaaaagggcagaattataaaatagatttgaaaactcagttggttaaaaatttagttagagcgaatgtagagctacttattttcaatgaatttcaagagttaatagagtttaaaacacctaaagagcgtcaaacaatagctaatgaattgaaattcatcagcgaagaagcaagagttccaatcgtcttagttggcatgccttggactgaacaaatcgctgaagaaccacaatggtcatctcgcttaatacgtagaagaaaacttgaatattttagtctccaaaaagacagtaaatattatcgtcaatatctaataggattagccaagcacatgccctttgatgagcctcccaagattgaagataaacatattgctataccattatttgcagcctgccgaggtgaaagtagggtattaaatcatctactatcagagacattaaaacttgtaatggtgaatggtgatcgcagtcttgatattaggcatttagctcaaacttatagaaaactttatgagagtcaggaaagtgaggctgcttcggttttttttaacccttttcttgagccgctagataaggtccttatttcagaagttgttaagccatcccgatataaccccaatgcgatgacccctgatgagatgttgattaagcgcgagttttctgcgccgagtaccttagctcaattactcagtaaatgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1628 - DNA, 12074 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgttctgccgaataggcagccaagaaaagtacagcgcggctgaaatcatcattaaagcggtgttctgccgaataggcagccaagaaatagcgaattccgagcgaaggagatattcatatgaatacagacattcaactttaccctgacgaatcgctcgaaagtttcttgctgcgcttatcgcaagaacaaggctacgagcgattttctcattttgctgaggacatctggttcgacacgttagatcagcatgaagcgattcccggtgctttccccttagaactcaaccgaatcaatatctaccatgcgcaaaccacaagccaaatgcgggtgcgagttcttatccatcttgagaaccaattaaaactcaataactttggtgcactgcgccttgcgttgtcacattcaaaagctcaattttctcccgaatacaaagccgtgcatcggttgggagctgattatccttttgtttttcttgctaaacgcttcacgcctatttgccctttatgtattagtgaggctccatacattcgccagcagtggcaatttctttctcagcaagtttgtgagcgccacggctgtaaattggttcatcactgcccagagtgccaatcgagattggaataccaaaccaccgaaagtattagccaatgcgaatgcggttttgaactccgcaactcacctgtagcagatgcgccagtggctgcgctactggttgcaagatggttgtcaggaaatgactcaaaacctttgggattactgaaggctgaaatgacgccctctgagcgctatggttttttactatggtacgttaatcgttacggtgatattgagaacatcagtttcgagtcatttgttgagtattgctcttgttggccaagagtgctccaggaagaacttgatgagttggtaaacaaagccgatctcattcgtatcaaagattggaaaaagacgtttttcaatgaagtttttggcgctttacttaaagattgccgccagttaccaagtaggcagttagagcgtaatagcgtgctcacgcaagtgttagcctactttacaaagttaatggcaacactaccttcaagcagcaaagggaatgtaggcgatgtgctgttgagccccttagaagtgtctacattgctttcttgcacaacggatgaggtgtatcggttgtatgagtttggtgagattaaagcagcgattaggccgcggatgcataccaaaattgccagtcatgaatcggcgttcaccctaagaagtgtcatcgaaacaaagctgactcgcatgtgctctgaaaatgacggtttaagcgtgtatctacctgagtggtaattatgacgaaattaagtgatctactagctattgaggacgaagcaataaaacaaactgctcttaagaagatgtttatgccctatacagaggacgtttgtgttgatgggtatgaacaagaaacgttgacgattttgcttaatctcagttctagtcatcaagctgataggtgctcggattggttagatgtagctcgggctcaaaggtatttaaaagaccgcgaaaacttagatgcctctcttgctgaaatccagtggttccacacacataacctaaagtttccagactgtcgagttaaggaccaacggataattgcgcgacctctttctacagccgaggagtttatttcaagtgcagtattggatcagcgattgggctgggctcataactctgctgtctatcgtcacacattatggttactgaatccttttaaatggcaatcacagccagtgtgtattctttcgcttattcagcagaaaaatccagtttggcttgatctgcttacagaatttggcttggatgtgaagtcacttgctcgcttacaacgtgcgattgaagaacagcttcctgagaatagttttcccgacagtgttagtacttacagtaagcaattacggtttcctttgggggatgattatgtttcgatcacccccgttgtgagtcacgcacttcagtgcgaactagaaataagagcgcgaagtccagaaaacaagttcagttttgtctcttcgtcactgcctaactctgccagtattgggaacctgtgtggcagtttgggtgggtatatgagagtcctaaattacccgctaggtgttaagcaggccaagggtgggacgttaacggaaaaccgtcaaaagagtggtcattactttgatgactatcaggtaactaacgccaaaatttgtcaggtgctaaatcgcctaattgggtctgagccatccaaaacacagcggcaaagagaaagggctcgtaaggttagaagtaagattttacgaaagcaaatagccttatggatgctgccactcattgagttaagagacatcgccgaatctgaacccaatcagcaacaactagagcatgacgacactttagctcaagcctttttgtcgttgccagaatgggagcttggctctttggctggtgagtttaaccgacgcttacatctcgcgtttcaaaataatatctattctgccaagtttgcttatcatcccaaactgatgcaggtagctaaagcacaagtgacatgggtgcttgagcaactaagtaagccaattaacaatcaagatacgttgacgggggagcaatatatctacctgtcgtcaatgagagtgcaagacgcggtagcgatgagtaacccttgtttgtgtggtgtgccgtctttgacggccatttggggattcatgcacgattatcaaaggcaatttaatcagttggttaacaatgattccccagttgagttttcgagtttcgctttttatgttcgtaacgagaatattcaatcaacagcgaagctgacagaaccaaactcagtcgccaaagctagaacggtttctaatgcgaaacgaccaaccattcgcagtgaacgattgtctgacctagaaatagacttagttatcagagttcatagtgaaagccgaatttcagattttagatcagcgcttaaaacggcccttcccgttgctttcgccggaggggcattataccaaccacagctatcgatgcagattgagtggcttagaacatttacaggcaggagtgaacttttccatgttttaaaaggattacctgcatacgggcgatggttatacccaagtgaaaagcaacctactaattttgatgagttagagcggttgctcactcaagacgatgataacttgcccgtttctcttggctaccatttattagagcatcctactaagaggggtaacgcaatcacaggttgtcatgcttatgcggagaatgcgatagggttagctaagcggataaacccgatagaggtccgttttagtggacgagatcactttttaaaccacgccttttggtcgatagaatgcagtagcgaaactattcttataaaaaactatagggattaatcgtttatggaactttgcactcagttgaactatgttcgatcactttctgctggcaaggcttatttctactatctatccgaaagtggtgagatgtgtccctttaatgtagatagaacccgattgcgcgcaccaaaagggagttattcagaagcatataaggggaacaagttcgttgacaagaatgttgccccccaagacttggcatattcaaaccctcagttcatcgaagagtgctatgtaaagcccggcgttgatgaaatctattgcgcattttcacttcgtattcgggccaattcgttaaccccagacatctgtagtgatgatgaagtgcgcagtaagctttctatgtttgctaagatttataaagaactcaacggatacaaagagttagctaatcgttatgcgaagaacatcttgcttggtacttggttatggcgaaatcgtgagtgcagaaatatcactattgaagtgacgaccagtgaattggatacctttgttgtcgaacatgctcaaaaactctcttggtatggtcattgggatggtgattcaacagaatgcttagaaaggcttactgcctatctggagcgagcattgtctgacccaactgaatacttctacatggacgtcaaagcgaaaatgcgggttggctggggagatgaggtttacccaagccaagagtttttggatagtcgagaagatggaatccctactaagcagctggccacagtagagcttttgagcggaaaagaaaccgtcgcgtttcacggacaaaaagttggtgcagcgttgcaatcgattgacgattggtggcatgaagaggctgataagcctttaagagtgaacgaatatggtgcagatcgagaatacgttatagcaagacgccatgtagcttatggaaatgacttctatcaattactcagaaatacagagaactggattgaaagtatgactgcttctgaatccattccgaatgacgtgcactttattatgtctgttttgatcaagggcggattgtttaattgcgccaaggccaattaagagggtctatcatgtctcaacggtactacttcttgatacgttacacgaatgctaatgccgactatggcttgctggcagggcgttgtatctcacaaatgcacttgtttatggttaatcaccaccaagcaatgaatagagtaggtgtgagttttcctgattggaatgaatcttcagttggtcaaaccattgcctttgtttccgaggacaaagagatgatgattggcctctcttttcagccctatttttcattgatggttaatgaaggtttgtttgagatctccagtgtttatgaggtgccagatacttccgaagaagtaaggtttgttcgtaatcagacgattgggaaaaactttttgggttccaaaaagcgtcgaatcaaacgcagtatggctagggccgagttatttggtattcaacaatcattaccagtaacgaatgaggaccgtgccatcgatagttttcatcaaatccctatttctagcggctcctcacggcaggattatattctgtttattcaaaaggaactcgcagatgagcgtgctgaatctggctttaatagctatggttttgcaaccaatcaagaaaaaagagcgacggttcctgacttacgttttaacccttttgacgaggactcttttttagttcagtagcctttaataaggagatatagcatgtacgtccgaaatctccgcaaaccatctgcaacaaaaaatgtgtacaagtttgcgagttctaaaaaccgaagtgtcattttgtgtgaaagttctttagaacgagattgttgttaccatctcgaatactctaaggacgttttttcattccaatcacaacccgaaggcttctattattcttcaggtaacaaacgttgtccctatactcctgattttctcgtgcgaaaccaagatggttcagagtattaccttgaagttaaacctctcgctaaaaccttttctgaagatttcaaacgttccttcgctctaaagcgtattgcagcacagcatcaaggaaaaccattagtattagtcacagataaacagatacgtaatggagtgtatctcgagaaccttaacttaatacatcgatatagtggactagtggatttcagcttgtcctcaacaaaaattgttgaggagttgagtactgctggaagaatgtgtattcgttcgcttgcggataacctgaaactatcgattggtgaagtgatagcagtcgtctttcgtttaattggattaggcagagttaatgtgcctttagattctgcaattaatgagatgtctgtgatctcggtgaattgaaatggtcatgccttttgatgatgagtttgaatccataaatgatgatactcaggccgaatatgattcaacttctgaggctaagctagttcgtaaacaatacctaccacttgattcagtcactattcatgaacgagatctgtcatctttttctgaagaacagaaaaacaaggcattagagcggtacaaacttatttctgctgtcgctaaagaaatatccggtggatggacacctaaaaatattaaccctttaattgataaatacggactcaatttatcgatcaaacggccaagttacaaatcagttattcgttggtataaatccttttgtgggagcgatggaaacattgtgtgtttagtggatcacaatcactcaaaaggaaatagaaccaaacgaattattgatgacgaatccttttttgttgaggccactgaacgttttcttgatgcaaaaagacccaactattcacaagcgtatcagttttactgcgacagaatcgaaattgaaaacagcaatattatctccggtcaaatatccaaagttagttatcaggcgtttaaagaaagattgaaaaaacttcccccttatgaagttgcattaaaacgatttggtcaaaattatgcgaacaaacttttcaattactaccaatcatcggttcctaccacgagaatattggaacgtgtagagctagaccatacaccactcgatttaatccttcttgatgatgacttactgatacctttaggtcgagcctatttgacgttattggtcgatgtgtttagtggctgtattgttggtttccatcttggtttcaatccccctagctatgtatctgttgctaaagcgatcatccattcagtaaaaagcaaagactatgttcatgatttgaatattgaactcactaatgactggttatgccacgggaaaatggaaacactggttgttgataatggagctgagttctggtcaaaaagtttagatcaagcatgcatggaggcaggtatacactatgaatattgtaaagtgggacaaccgtgggaaaagcctcgtgttgaaaggaaatttttagaaattattcagggaattgtaggatgggttccgggaaaaactttttctaatatattggaaaaagatcggtatgacccacaaaaagacgccgtaatgcggtttagtagttttgttgaggagctacatcgctggatcattgatgttcataatgcctcccctgactctcggaatacgaagattcccaattaccattggaaaaagagtgaagaagccttaccacccgcagcgcttagtgaccgagatgaaaagcagttccgaatcattatgggggttattcatgaaggcgttgtgacaactaaaggtataaaatataagcacttaatgtatgacaatgtggcgttagaacaatatcggaagcagtacccacaaacaaaaaagtctcgtaagaaaacaataaaaattgaccccgatgatctgtctagcatattcgtttatctggaggaaatcggtggatacatcgaagttccctgcaaatacgatcctttgggatacacaaagaatctgtcactgagtgagcatgttcgcattactaaaatacatcgtgattttataaaaggccaagtggatgctttatcattagcgaaagctcggcaggcacttcatgaacgtattaaaacggagcaagagcacctttctttaatgtcagttgagagtcgagcgaaaaaagccaaacatggtaagaaaatggcagctctttccggaatatcaaatgagcagcctatgtccatacagaatgctttagaaaacaaaaacaagccgttagatgacaactttgacgagcctactcctgtagacaatctaaaatcgctctggaataaacgcaaagcgatgaaaaggtctaaagaatgaatctatctgctaaacaagaaattgctgtcgatgaattactaactcaataccacaattcattcgttatttatccagatgtgcaacagatattcgatggccttgattggattgtacgtcgcagtcaatttggaaattttacgccatctatgcttataactggtggcacaggtgcgggcaaaacatcacttattaatcattatgcaaaatatcattttaatgacaatgaagtgttaatcactcgcgtcagaccaagttttatcgaaacacttatctgggccattgataagttgggtattccttataacactcgttctaaacgttcagaaattggtttacaggattatttcatcaatagtgttaagaaatccaatcttaaactgttggtcatagaagaggctcaagaattgtttgaatgtgcatctcctaaagaaagacaaaaaatacgtgaccgattaaagatgataagtgatgagtgccggttgcctatagtctttattgggattcctactgctaaacttattttggaagattcacagtgggatagacgaattatggttaaaagagaactgccttatattcgtataacatcggaatcttcgttagatgtatacatcgatttacttgaggagcttgaaaagcagcttcctatttctgttcaaccggagctttcagagatggacatcgcaatgcgattattatcggctaccaaagggatgctgggagccattaaagagttagtcggctatgcattagagctggcgctgctatcaggtaaatcagcaatcaccaacgacgaatttgcattgggattcgagagaatcaatggccccgatgtaacgaatccgtttacaacagaattggaaaagctattggtcccgcaagttattgagtacgaggggttcatcattgaccccgaaaatggcgaaatcaaatttactaaacaaatatttaaagacataccattagcagctctattgggttagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1629 - DNA, 12096 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgttctgccgaataggcagccaagaaagtacagcgcggctgaaatcatcattaaagcggtgttctgccgaataggcagccaagaatagcgaattccgagcgaaggagatatacatatgaaaacggacattcaacattactctgacgaatcgcttgaaagtttcttgttgcgtttatcgcaagagcaaggttacgagcgattttctcatttcgccgaggacatttggttcgacactatggagcagcatgaagcgattgctggtgctttccccttagaactcaaccgaatcaatatttatcacgcccaaaccacaagccaaatgcgggtgcgagttcttatccatcttgagaaccaattaaaactcaataactttggtgtactgcgtctcgcgttgtcacattcaaaagctcaattttctcccgaatacaaagccgttcatcggttgggttctgattatcctttcgtttttcttggtaaacgcttcacgcctatttgccctttatgtattagtgaggctccatacattcgccagcagtggcaatttctttctcagcaagcctgtgagcgccacggttgtaaattggttcatcactgcccagagtgccaatcgagattggaataccaaacaactgagagtattagccaatgcgaatgcggttttgaactccgcaactcaccagtagaagatgcgccagtggctgcgctactggttgctcgatggttgtcaggaaatgactcaaaacctttgggattactgaaggctgaaatgacgctctctgagcgctatggttttttactatggtacgttaatcgttacggtgatattgagaacatcagttttgagtcatttgttgagtattgctcttgttggccaagagtgctgaaggaagaacttgatgagttggtaaacaaagccgatctcattcgtatcaaagattggaaaaagacgtttttcaatgaagtttttggcgctttgcttaaagattgccgccagttaccaagtaggcagttagagtgtaatagcgtgctcactcaagtgttagcctactttacaaagttaatggcagcaataccttcaagcagcaaagggaatgtaggcgatgtgctgttaagccccttagaggcttctacattactttcttgcacaacggatgaggtgtatcggttgtatgagtttggtgagattaaagcagcgattaggccgcggatgcataccaaaattgccagtcatgaatcggcgttcaccctaagaagtgtcatcgaaacaaagctgactcgcatgtgctctgaaaatgacggtttaagcgtgtatctacctgagtggtaattatgacgaaattaagtgatctactagcaatcgaggacgaagcaataaaacaaactgctcttaagaagatgtttatgccctatacagaggacgtttgtgttgatgggtatgaacaagaaacgttgacgattttgcttaatctcagttctagtcatcaagctgataggtgctcggattggttagatgtagctcgggctcaaaggtatttaaaagaccgcgaaaacttagatgcctctcttgctgaaatccagtggttccacacacataacctaaagtttccagactgtcgtgttaaggaccaacggataattgcgcgacctctttctacagccgaggagtttatttcaagtgcagtattggatcagcgattgggctgggctcataactctgctgtctatcgtcacacattgtggttactgaatccttttaaatggcaatcacagccagtgtgtattcttttgcttattcagcagaaaaatccagtgtggcttgatctgcttacagaatttggcttggatgtgaagtcacttgctcgcttacaacgtgctattgaagaacagcttcctgagaatagttttcccgacagtgttagtacttacagtaagcaattacggtttccgtggggtgatgattatgtttcgatcacccccgttgtgagtcatgctctccagtgcgaactagaaataagagcgcgaagtccagaaaacaagttcagttttgtctcttcgtcactgcctaattctgccagtattgggaacctgtgtggcagtttgggtgggtatatgagagtcctaaattacccgctaggtgttaagcaggccaagggtgggacgttaacggaaaaccgtcaaaagagtggtcattactttgatgactatcaggtaactaacgccaaaatttgtcaggtgctaaatcgcctaattgggtctgagccatccaaaacacagcggcaaagagaaagagcacgtaaggttagaagtaagattttacgaaagcaaatagccttatggatgctgccactcattgagttaagagacatcgccgaatctgaacccaatcagcaacaactagagcatgacgacactttagctcaagcctttttgtcgttgccagaatgggagcttggctctttggctggtgagtttaaccgacgcttacatctcgcgtttcaaaataatatctattctgccaagtttgcttatcatcccaaactgatgcaggtagctaaagcacaagtgacatgggtgcttgagcaacttagtaagccaattaacaatcaagatacggtgacgggggagcaatatatctacctgtcgtcaatgagagtgcaagacgcggtagcgatgagtaacccttgtttgtgtggtgtgccgtctttgacggccatttggggattcatgcacgattatcaaaggcaatttaatcagttggttaacaatgattccccagttgagttttctagtttcgctttttatgttcgtaacgagaatattcaatcaacagcgaagctgacagaaccaaactcaatcgccaaagctagaacggtttctaatgcgaaacgaccgaccattcgtagtaaacgattggccgacctagaaatagacttagttatcagagttcatagtgaaagccgaatttcagattttagatcagcgcttaaaacggcccttcccgttgctttcgccggaggggcattataccaaccacagctatcgacgcagattgagtggcttagaacatttacaggcaggagtgaacttttccatgttttaaaaggattacctgcatacgggcgatggttatacccaagtgaaaagcaacctactaattttgatgagttagagcggttgctcactcaagacgatgataacttgctcgtttctcttggataccatttgttagagcacccaactaagcgggataacgcaatcacaggttgtcatgcttatgcggagaatgcgatagggctggctaaacgaataaacccgatagaggtacgttttagtggacgagatcactttttaaaccacgccttttggtcgatagaatgcagtagcgaaactattcttataaaaaactatagggattaatcgtttatggaactttgcactcagttgaactatgtccgatcactttctgctggcaaggcttatttctactatctatccgaaagtggggagatgtgtccccttgatgtagatagaacccgattgcgcgcaccaaaagggagttattcagaagcatataaggggaataagttcgttgacaagaatgttgccccccaagacttggcatattcaaaccctcagttcattgaagagtgctatgtaaagcccggcgttgatgaaatctattgcgcattttcacttcgtattcgagccaattcgttaacaccggatatgtgtagtgatgatgaagtacgcagtaagctttctatgcttgctaaaatttataaagatctcaacggatacaaagagttagcccatcgttatgcgaagaacatcttgcttggtacttggttatggcgaaatcgtgagtgcagaaatatcactattgaagtgacgaccagtgaattggatacctttgttgtcgaacatgctcaaaaactctcttggtatggtcattgggatggtgattcaacagaatgcttagaaaggcttacagcctatctggagcgagcattgtctgacccaactgaatacttctacatggacgtcaaagcgaaaatgcgggttggctggggagatgaggtttacccaagccaagagtttttggatagtcgagaagatggaatccctactaagcagctggccacagtagagcttttgagcggaaaagaaaccgtcgcgttccacggacaaaaagttggtgcggcgttacaatcgattgatgattggtggaatgaaaacgcagataagccattaagagtgaatgaatatggtgctgaccgagagtacgttatagcaaggcgacacgtaacccacggaaatgacttttaccaattagtcagaaatacagagaattggattgagacaatgacagcttctcgaaccatcccaaatgatgtgcactttattatgtctgttttgatcaagggcggattgtttaattgcgccaaggccaattaagaggttctatcatgtctcaacggtactacttcttgatacgttacacgaatgctaatgccgactatggcttgctggcagggcgttgtatctcacaaatgcacttgtttatggttaatcaccaccaagcaatgaatagagtaggtgtgagttttcctgattggaatgaatcttcagttggtcaaaccattgcctttgtttccgaggacaaagagatgatgattggactctcttttcagccctatttttcattgatggttaatgaaggtttgtttgagatctccagtgtttatgaggtgccagatacttccgcagaagtaaggtttgttcgtaatcagacgattgggaaaaactttttgggttccaaaaagcgtcgaattaaacgcagtatggctagggccgagttatttggtgttgaacaatcattaccagtaacgaatgaggaccgtgtcatcgatagttttcatcgaatccctatttctagcggttcttcacggcaggattttattctgtttattcaaaaggaactcgcagatgagcgtgctaaatctggctttaatagctatggttttgcaaccaatcaagaaaaaagagcgacggttcctgacttacgttttaacctttttgaagaagattctttttagcctttaataaggagatatagcatgtttgaccaaactaagaaatcatctcatgtgcacaacatctgtaagttcatgagcttgaagaatgatgctgttgttcgcactctctccattctggagttcgatttctgttttcacctcgaatacaacccaaacatcaaaagttttacctctcaaccttttggtttccactatctattcaataaccgtaagtgtcgatatacccctgactttttagcaataggtcacaatgagcaatcaacattcttcgaggtcaaacactctagccagattcctaaacctgattttagggagcgctttgaagaaaagcagagagtagcgttgagtgagttcaacagacggttagttctcgttactgagaagcaaatcaggatggggccaacgctagataactttaagttgttacaccgctactcaggattgcgaacagtgaccgaatttcaaaagcgagttttggcatttattcaacgtaagcaaatggtgaagttgcaagaggtgtctttgtattttggtctatcagagcaagacacgcttatctctactctaccttggatctcttcggggcacgttaaaacagatctcaacactattggctttggtctggaaacttgcgtttggtgctaactatgccaccggactctaatagtatatttgggttctttgatgagtttgaagcgtcagaagaagaatcgcagttgctcccaaaagagctaattctcgagcccgttgaaatatcatcgaccatagatagtttgccagcaaaaattcaggaggaggttcttcgccgcataaaagtgattacttttgtggagaagcgcttgaaaggtgggtggacagagaaaaacttgaaccccattttaagtctcgttgaatcagaattacagcttactccccctagttggcggactgtagcaacttggaaaaaatcctacgctgaagcaggtagagaggcttcggcacttattccgaagcatacgtttaagggcaaccgccagaaagaaatggattcgcaatccttgattgacgaggcaattcagaacgtatacctgacacgtgaacgacttagcgttgcagaagcataccgatattataagagtcgagtgattcaaatgaatcgagggattgttgaaggaaaaatcaagccaatcgccgaacgttctttttataatagaataaatgagttacccccttatgaagtggcgattgcaagatttggtaaacgatatgcagatcgggagtatcggtcggttggtcagcaggtagttgcaactaaacctatggagtttgttgaaatagaccataccccagttccagtgatcttgattgacgatgaactagatattcctttgggccgcccttatttgacgatgctttatgaccgtttcagtaagtgcattgttggttgcagtatcaactttagagagccaagttttgactctgttagaaaggctctgttgaactcacttttggataaaagctggcttaaagcaaagtatccatcgattgagaatgagtggccttgccacggtaagattgattgcttggtcgtcgataacggtgccgagttttggagtcaaagtttggaagattcgttacggcctttggtgtctgacattcaatacagtcaagcagcgaagccttggcgaaagtcagggatcgaaaagttgttcgatcaaatgaataaagggttagttaacgcgctgcctggaaaaaccttcaccaatcctactcaactacaagattacaatccaaagaaggatgcggtggttagggtatcggtatttcttgaattacttcataaatggattgtcgattattaccacatggcaccagattccagagagcgcgagatcccataccacaagtggcaccaatcgaaatggacgccgtcttactatgatggtgctgagaaggagcaactcagagtagagttaggattgcttagacacaggacgattggagtggccgggatcaggctgcataacttacgctatcagtccgccgagcttattgaataccggaaatattgcacacctaataatggcaaacagctctttgttaagaccaaaacagatccttctgacatcagctacattcatgtttacctagaatcagaaaagaagtacataaaagttccagcagtagacaactccggatatacaaacggactttcactttttgaacaccaacgcatacaaaaagtacgcagactgaacaccaaggatcttgctgatgatgaggctcttgcggatacatttctgtatatgaaaaaacgtatccacgaagaaaccgatagattccgtcgtgttaaaagtagcaagcccaaccttcctaaaacaggtaacacgtcgagactagcaaagtttaatgatgtcggttctgagggaccaaactcaatcaacgtgactcctgttaggctcaaatctgaggttgtttccgatgcctcagagtacttagatgacgatgattttgaagatattgaagggtattagtttgaatttaacgccaaagcagcttgagcagctaaagtcctttgaaacctgctttatcgagtatcccgcgataactgaaatctactccattttcgatcaacttcgtttcaatcactctttaggtggtgaaccagaatctttcttgttaactggtgaggctggaagtggaaagacagctttgatcaacaactacttgtcacgctttcaatcgggttcaacttggggaaagcagccagtattaagcactagagtgccaagtcgtatcaatgaacagaatacgctgacccaatttttggttgatttagattgtaaatcaggaggacgaggtattcggcgccgtaatgaaattgcgcttggcgaagcggttgtaaagcaacttaaacgtaaatctgttgagctgattattgttaatgaaattcaagagcttgttgagttttcaaccgcagaacagagacaagttattgccaacacattcaaatatatgagtgaagaagcaagagtttcttttgtgcttgtgggtatgccttatgctgatgtgatagcgacagaaccacaatggaactcgcggctaagctggagaagaaagatagattatttcaaattgttgaaagcgaatagtcattcgagtaaaacggcatcttatgggtttgacttagaacaaaaaaaacattttgccagatttgtcgcgggtctgagttcaaggatggggtttgatgagccaccagtacttacaaagaatgaactgctatatcctttgtttgcaatgtgccgaggagaatgccgagcgttaaaacacttcttgaaagacgcgttgcttacgagcttcaacgacaatgcggatacgatagacaaagcaatattgtcacgcacttttgcatttaagttcccctacctagataacccgtttgatcgtcctttagagcagcttagtctccatcaaattgactctggttctgcttaccacttaaatgcaatcaccactgaagataaaatagtagcccctcgttttacggacgccattccgttgagcatgctattgagcaaaaatgggcttaaagcctagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1630 - DNA, 3910 bp, Artificial Sequence; identical to SEQ ID NO: 409
  Synthetic

SEQ ID NO: 1631 - DNA, 9133 bp, Artificial Sequence
  Synthetic
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgctaatacgactcactatagggtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctccaaaaggtgggttgaaagcgagaccctcgacgagggtctcggtaccctagcataaccccttggggcctctaaacgggtcttgaggggttttttggtcgaacagaaagtaatcgtattgtacacggccgcataatcgaaattaatacgactcactataggggaattgtgagcggataacaattccccatcttagtatattagttaagtataagaaggagatatacatatgagcacaatcacgattcaatgccgcctagttgcagaagaagcgaccctgcgctacttttgggaacttatggctgagaagaatacgccactcattaatgaattgttggagcagttaggacaacatccagattttgatacttgggtacaagcaggcaagatgcctgaaaagacagttgagaacttgtgcaagtccctagaagatcgagaaccttttgcaaatcagcccggtcgttttcgtacttcggcagttgctctggtaaagtacatttacaaatcctggtttgcgttacaaaaacgtcgggcggacagactagaaggtaaagagcgctggttaaagatgctcaaaagtgatgtggaactggaacgagaaagcaactgtagtttggatattattcgagctaaagctggggaaattcttgctaaagttactgaggggtgcgctccgagcaatcaaacatcctctaagagaaaaaagaagaaaactaaaaaaagccaagcgacaaaagatctccctacgcttttcgagattatattaaaggcttacgaacaagctgaagaaagcctgacacgagctgcccttgcttatctccttaaaaatgactgtgaagtcagtgaagttgatgaagattcagagaaatttaaaaagcgtcggcgtaaaaaggaaatagaaattgaacgtttaagaaatcaactgaaaagtcggatacctaaaggtcgcgatttaaccggagataagtggttgaaaacgctagaagaagccacccgaaatgttcctgaaaatgaggatgaggcaaaggcttggcaagcccaactcttgagagaagctagttctgttccttttcctgtagcttatgaaactagtgaagatatgacttggtttaccaacgagcaaggtcgaatctttgtttactttaatggttcagccaaacataaatttcaagtttattgcgatcgccgtcaacttcattggtttcaacgttttgtagaggactttcaaatcaagaaaaatggtgataaaaaaggtagcgaaaaggagtaccctgctgggttattgacgctttgttccactcgtctgagatggaaagaaagcgcggaaaaaggagatccttggaatgttcatcgcctaattctttcttgcactatcgatacacgcttatggacacttgaaggaacggaacaggtgcgagctgaaaagatcgctcaggttgaaaaaactattagcaagcgggagcaagaagttaatctgagtaagactcaacttgagcgtttacaagccaagcacagtgagagggagagattgaacaacatttttcccaaccgccctagcaagcccagttaccggggtaaatctcatattgcgatcggtgtaagtttcagtttggaaaacccagccactgttgccgtcgtagatgttgcaaccaagaaagtccttacttaccgcagtttcaaacaattactcggagataactacaaccttgcaaaccggctgcggcaacaaaagcaacgtctttctcacgaacgtcacaaagctcagaaacaaggcgcaccaaattcatttggagactcagagttagggcagtatgtagacagattgcttgcaaaatcgattgtcgcgatcgcaaaaacttatcaagctagtagtattgtcttgcctaaacttcgctatatgagggaaatcatacataatgaagttcaagctaaagccgaaaaaaagattccaggatataaagaaggtcaaaaacaatatgccaaacagtatcggataagcgttcatcaatggagttataatagattatcacagattcttgaaagccaagctacaaaagctggaatttctattgaacgtggatcgcaagtaatccaaggtagctcccaagaacaagcacgagatttagctttatttgcctataacgaacgccaacttagtctgggttagtaacctttaataaggagatataccatgggcttagacgaagaatttgagttcactgaggaattgacgcaagctccagatgttattgtgcttgacaagagtcattttgtggtagacccatcccaaattattctgcaaacatcggataagcataaactgagatttaatcttatcaagtggttcgctgaatcccccaacattactattaaatctcagagaaaacaggcagtcgtagatacccttggtgtttctactcggcaggtggagcgtctcctcaagcaatatcataatggtgagttatcagagacagcgggagtacaacgctcagataaggggaaacttcgcatcagccaatactgggaagattatattaaaacaacttatgaaaaaagtctgaaagataaacatccaatgttgccagcagctgtcgtgcgggaagtgaagcgacacgcgatcgttgacctcggactgaaaccaggagattatccccatccagccaccatctatagaaatttagctcctttaatcgagcaacacacgcggaagaaaaaagttagaaatccgggttcgggatcttggctgaccgttgtcacgcgagatggtcagctactgaaggctgactttagtaaccaaattatccaatgcgaccataccgagctggatattcatatagttgatagtcatggcagtttattgtctgaccgtccttggctaactactgttgtcgatacttattcaagttgcattcttggttttcatttatggatcaaacaaccaggttctacggaggtagctcttgccttgagacacgccattctacccaaaaattatccagaggactacaaacttggcaaagtttgggaaatatatggacctccttttcagtatttttttactgatggtggaaaagattttaattcaaagcatctaaaagccattggtaagaaattaggatttcagtgcgaactacgcaatcgcccgccccaaggtggaattgtagaacgtctttttaaaaccattaatactcaagttcttaaagagcttcccggttacacgggggcaaacgttcaagaacgcccgaaaaatgcagagaaagaagcctgtttaacaatacaggatttggataaaattctagccagcttcttttgtgatatttataaccacgaaccctatcccaaggagcctcgcaacacgagatttgaacgctggtttaaaggtatggggggaaaattacccgaacctttggacgagcgagaattggatatttgtttgatgaaagaagcacaacgagttgttcaagctcatggtagcatacagtttgaaaacctaatttatcgaggagaagctctgaaggcatatagaggtgaatacgtcaccctaagatacgatcccgaccatgtcctgactttatatgtctatagttgcgaagctgatgataatgcagaagagttcttgggctatgctcacgctataaacatggatactcatgacttgagtatagaagaattgaaaactctcaataaagaacgaagtaaagctcgtagcgatcattacaactatgatgctttattagcattgggtaaacgcaaagaacttgtagaagaaagaaaacaagacaagaaagcaaaaaggcaatcagagcaaaaacgtctccgcactgcttccaagaaaaactcaaatgttattgaactacgcaaaagtagagcttcgagttcttcaagtaaagatgaccgacaggaaattttaccagagagagtttctagggacgaactaaagccggagaaaacagaactgaaatatgaggaaaatctgttagcacagaccgatactcaaaaacaggagagacataagttagttgtctctgaccgtaaaaaaaatttaaagaacatttggtgataaaggaggtaaataatggccatatctcaactggcaacccaaccatttgtcgaagtcttacctccagagttagatagcaaagctcaaattgctaaaactattgatattgaggagcttttcagaattaattttatcacaaccgatcggtcatcagaatgtttcagatggttagatgagctgcgtatcctgaaacaatgcggtcggatcattggaccaagaaatgtaggcaaaagccgagcagtgcttcactatcgtaatgaggataaaaaacgagtttcttatgtaaaggcttggtcggcatcgagttctaaacgtctattttcacaaatcttaaaggatattaaccatgctgcatcaacaggtaaacgacaggatttacgtccaagattagctggtagtcttgaactatttggattagaattggtcattgttgataatgctgaaaatcttcaaaaagaggcgctcttagatttaaagcaactttttgaagaatgccatgttcctattgtcttagttggaggtaaggagttagatgatattttagaagattttgatttgttgactaactttccaacgttatatgagtttgaacgattggaacatgatgattttataaaaacattaaagacaatcgaattggatattttatctcttccagaagcgtctaagttaagtgagggtaacatatttgcaattttagctgagagtacaggtgggaaaataggaattttagtcaagatactaactaaagcagttttacattctcttaaaaagggatttggtaaagttgatgaaagcattttagaaaaaatcgcaagtcgttatggaacaaaatacgttcccattgaaaacaaaaatagaaacgattaatagaggaggatataaatgattgaagatgatgaaattcgtctaaggttgggctatgttgaaccacacccaggtgaaagcatcagtcattatttgggacggcttcgtcgatttaaggctaacagccttccttcaggatatgctctaggaaaaattgcgggtcttgggtctgttctgactcgatgggaaaagttgtacttcaacccatttcccactcaacaagaactagaggcattagcacaagtgattcaagtggaggttgagaaattaagagagatgctacccactaaaggtgtcacaatgatgcctcgacccattcgattatgtgcggcttgctatgcagagtcaccttatcaccggatcgagtggcagtttaaggacaaaatgaagtgcgatcgccatcagttgcgcttattaacaaaatgcacaaactgtcagacaccattccccattcctgctgattgggaaaaaggagaatgctcgcattgttttttgtcttttgctaagatggtgaagtgtcaaaagcgtcgttagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 1632 - DNA, 10375 bp, Artificial Sequence
  Synthetic
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgctaatacgactcactatagggtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctccaaaaggtgggttgaaagcgagaccctcgacgagggtctcggtaccctagcataaccccttggggcctctaaacgggtcttgaggggttttttggtcgaacagaaagtaatcgtattgtacacggccgcataatcgaaattaatacgactcactataggggaattgtgagcggataacaattccccatcttagtatattagttaagtataagaaggagatatacatatgagcacaatcacgattcaatgccgcctagttgcagaagaagcgaccctgcgctacttttgggaacttatggctgagaagaatacgccactcattaatgaattgttggagcagttaggacaacatccagattttgatacttgggtacaagcaggcaagatgcctgaaaagacagttgagaacttgtgcaagtccctagaagatcgagaaccttttgcaaatcagcccggtcgttttcgtacttcggcagttgctctggtaaagtacatttacaaatcctggtttgcgttacaaaaacgtcgggcggacagactagaaggtaaagagcgctggttaaagatgctcaaaagtgatgtggaactggaacgagaaagcaactgtagtttggatattattcgagctaaagctggggaaattcttgctaaagttactgaggggtgcgctccgagcaatcaaacatcctctaagagaaaaaagaagaaaactaaaaaaagccaagcgacaaaagatctccctacgcttttcgagattatattaaaggcttacgaacaagctgaagaaagcctgacacgagctgcccttgcttatctccttaaaaatgactgtgaagtcagtgaagttgatgaagattcagagaaatttaaaaagcgtcggcgtaaaaaggaaatagaaattgaacgtttaagaaatcaactgaaaagtcggatacctaaaggtcgcgatttaaccggagataagtggttgaaaacgctagaagaagccacccgaaatgttcctgaaaatgaggatgaggcaaaggcttggcaagcccaactcttgagagaagctagttctgttccttttcctgtagcttatgaaactagtgaagatatgacttggtttaccaacgagcaaggtcgaatctttgtttactttaatggttcagccaaacataaatttcaagtttattgcgatcgccgtcaacttcattggtttcaacgttttgtagaggactttcaaatcaagaaaaatggtgataaaaaaggtagcgaaaaggagtaccctgctgggttattgacgctttgttccactcgtctgagatggaaagaaagcgcggaaaaaggagatccttggaatgttcatcgcctaattctttcttgcactatcgatacacgcttatggacacttgaaggaacggaacaggtgcgagctgaaaagatcgctcaggttgaaaaaactattagcaagcgggagcaagaagttaatctgagtaagactcaacttgagcgtttacaagccaagcacagtgagagggagagattgaacaacatttttcccaaccgccctagcaagcccagttaccggggtaaatctcatattgcgatcggtgtaagtttcagtttggaaaacccagccactgttgccgtcgtagatgttgcaaccaagaaagtccttacttaccgcagtttcaaacaattactcggagataactacaaccttgcaaaccggctgcggcaacaaaagcaacgtctttctcacgaacgtcacaaagctcagaaacaaggcgcaccaaattcatttggagactcagagttagggcagtatgtagacagattgcttgcaaaatcgattgtcgcgatcgcaaaaacttatcaagctagtagtattgtcttgcctaaacttcgctatatgagggaaatcatacataatgaagttcaagctaaagccgaaaaaaagattccaggatataaagaaggtcaaaaacaatatgccaaacagtatcggataagcgttcatcaatggagttataatagattatcacagattcttgaaagccaagctacaaaagctggaatttctattgaacgtggatcgcaagtaatccaaggtagctcccaagaacaagcacgagatttagctttatttgcctataacgaacgccaacttagtctgggttagtaacctttaataaggagatataccatgggcttagacgaagaatttgagttcactgaggaattgacgcaagctccagatgttattgtgcttgacaagagtcattttgtggtagacccatcccaaattattctgcaaacatcggataagcataaactgagatttaatcttatcaagtggttcgctgaatcccccaacattactattaaatctcagagaaaacaggcagtcgtagatacccttggtgtttctactcggcaggtggagcgtctcctcaagcaatatcataatggtgagttatcagagacagcgggagtacaacgctcagataaggggaaacttcgcatcagccaatactgggaagattatattaaaacaacttatgaaaaaagtctgaaagataaacatccaatgttgccagcagctgtcgtgcgggaagtgaagcgacacgcgatcgttgacctcggactgaaaccaggagattatccccatccagccaccatctatagaaatttagctcctttaatcgagcaacacacgcggaagaaaaaagttagaaatccgggttcgggatcttggctgaccgttgtcacgcgagatggtcagctactgaaggctgactttagtaaccaaattatccaatgcgaccataccgagctggatattcatatagttgatagtcatggcagtttattgtctgaccgtccttggctaactactgttgtcgatacttattcaagttgcattcttggttttcatttatggatcaaacaaccaggttctacggaggtagctcttgccttgagacacgccattctacccaaaaattatccagaggactacaaacttggcaaagtttgggaaatatatggacctccttttcagtatttttttactgatggtggaaaagattttaattcaaagcatctaaaagccattggtaagaaattaggatttcagtgcgaactacgcaatcgcccgccccaaggtggaattgtagaacgtctttttaaaaccattaatactcaagttcttaaagagcttcccggttacacgggggcaaacgttcaagaacgcccgaaaaatgcagagaaagaagcctgtttaacaatacaggatttggataaaattctagccagcttcttttgtgatatttataaccacgaaccctatcccaaggagcctcgcaacacgagatttgaacgctggtttaaaggtatggggggaaaattacccgaacctttggacgagcgagaattggatatttgtttgatgaaagaagcacaacgagttgttcaagctcatggtagcatacagtttgaaaacctaatttatcgaggagaagctctgaaggcatatagaggtgaatacgtcaccctaagatacgatcccgaccatgtcctgactttatatgtctatagttgcgaagctgatgataatgcagaagagttcttgggctatgctcacgctataaacatggatactcatgacttgagtatagaagaattgaaaactctcaataaagaacgaagtaaagctcgtagcgatcattacaactatgatgctttattagcattgggtaaacgcaaagaacttgtagaagaaagaaaacaagacaagaaagcaaaaaggcaatcagagcaaaaacgtctccgcactgcttccaagaaaaactcaaatgttattgaactacgcaaaagtagagcttcgagttcttcaagtaaagatgaccgacaggaaattttaccagagagagtttctagggacgaactaaagccggagaaaacagaactgaaatatgaggaaaatctgttagcacagaccgatactcaaaaacaggagagacataagttagttgtctctgaccgtaaaaaaaatttaaagaacatttggtgataaaggaggtaaataatggccatatctcaactggcaacccaaccatttgtcgaagtcttacctccagagttagatagcaaagctcaaattgctaaaactattgatattgaggagcttttcagaattaattttatcacaaccgatcggtcatcagaatgtttcagatggttagatgagctgcgtatcctgaaacaatgcggtcggatcattggaccaagaaatgtaggcaaaagccgagcagtgcttcactatcgtaatgaggataaaaaacgagtttcttatgtaaaggcttggtcggcatcgagttctaaacgtctattttcacaaatcttaaaggatattaaccatgctgcatcaacaggtaaacgacaggatttacgtccaagattagctggtagtcttgaactatttggattagaattggtcattgttgataatgctgaaaatcttcaaaaagaggcgctcttagatttaaagcaactttttgaagaatgccatgttcctattgtcttagttggaggtaaggagttagatgatattttagaagattttgatttgttgactaactttccaacgttatatgagtttgaacgattggaacatgatgattttataaaaacattaaagacaatcgaattggatattttatctcttccagaagcgtctaagttaagtgagggtaacatatttgcaattttagctgagagtacaggtgggaaaataggaattttagtcaagatactaactaaagcagttttacattctcttaaaaagggatttggtaaagttgatgaaagcattttagaaaaaatcgcaagtcgttatggaacaaaatacgttcccattgaaaacaaaaatagaaacgattaatagaggaggatataaatgattgaagatgatgaaattcgtctaaggttgggctatgttgaaccacacccaggtgaaagcatcagtcattatttgggacggcttcgtcgatttaaggctaacagccttccttcaggatatgctctaggaaaaattgcgggtcttgggtctgttctgactcgatgggaaaagttgtacttcaacccatttcccactcaacaagaactagaggcattagcacaagtgattcaagtggaggttgagaaattaagagagatgctacccactaaaggtgtcacaatgatgcctcgacccattcgattatgtgcggcttgctatgcagagtcaccttatcaccggatcgagtggcagtttaaggacaaaatgaagtgcgatcgccatcagttgcgcttattaacaaaatgcacaaactgtcagacaccattccccattcctgctgattgggaaaaaggagaatgctcgcattgttttttgtcttttgctaagatggtgaagtgtcaaaagcgtcgttagtaacctaggctgctgccaccgctgagcaataactagcataaccccttggggcctctaaacgggtcttgaggggttttttgctgaaacctcaggcatttgagaagcacacggtcacactgcttccggtagtcaataaagcctgcagcaaagactacctacttaaatgaaccgcaaatgtacattcgcaaattaaatgtcgtaattcgcaaatttgtgtcgtttttcgcaaattaatgtcgtttagaatagtttgtctcatcaattcaattataggaacttttcgcaaattaatgtcgtcctgtttctccatttagtgtcgattaacaaattaatgtcgctgttaacgaattaatgtcgtcgaattagttccaactaacgttaacaaattaatgtcgtctaacataatgtcttgctaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagaaaaaccactgattaacactttaggtactaaagtaccactaatgtggcaaaaatgcgacatctaatttgcgaaacaggcaaatcttaataaacgacatttaatttgcgaaaataggatttgcgacatctaatttgcgaaacaggcaaattactcagttttatggataaatagcttgtaagtcctacgcaataaagatctcagctattagaagtaattgcgacactaatttgcgaattgcgacatataatttgcgaatgtacaccaagctttaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 1633 - DNA, 23 bp, Artificial Sequence
  Synthetic
cgagaccctcgacgagggtctcg

SEQ ID NO: 1634 - DNA, 23 bp, Artificial Sequence
  Synthetic
cagcgcggctgaaatcatcatta

SEQ ID NO: 1635 - DNA, 23 bp, Artificial Sequence
  Synthetic
cggataatgcgaacagcgcacgg

SEQ ID NO: 1636 - DNA, 23 bp, Artificial Sequence
  Synthetic
tttagcgaaaccgccaagactgt

SEQ ID NO: 1637 - DNA, 23 bp, Artificial Sequence
  Synthetic
aggcggtcgggatagttttcttg

SEQ ID NO: 1638 - DNA, 23 bp, Artificial Sequence
  Synthetic
cagcggttccttactggcattga

SEQ ID NO: 1639 - DNA, 23 bp, Artificial Sequence
  Synthetic
ttcgacgttcagacgtagtgtga

SEQ ID NO: 1640 - DNA, 12828 bp, Artificial Sequence
  Synthetic
gcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaacgaccgagcgcagcgagtcagtgagcgaggacacaagctttgacagctagctcagtcctaggtataatactagcgtcgacgtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgg

SEQ ID NO: 1641 - DNA, 32 bp, Artificial Sequence
  Synthetic
gagacctctgtcttgtcagctagggtggtctc

SEQ ID NO: 1642 - DNA, 4593 bp, Artificial Sequence
  Synthetic
ccgccgcagtctcacgcccggagcgtagcgaccgagtgagctagctatttgtttatttttctaaatacattcaaatatgtatccgctcatgagacaataaccctgataaatgcttcaataatattgaaaaaggaagagtatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgaggggccgcaagatccggccacgatgacccggtcgtcggttcagggcagggtcgttaaatagccgcttatgtctattgctggtttaccggtttattgactaccggaagcagtgtgaccgtgtgcttctcaaatgcctgaggtttcagcaaaaaacccctcaagacccgtttagaggccccaaggggttatgctagttattgctcagcggtggcagcagcctaggcatctccacaaaaggcgtagtgtacagtgacaaattatctgtcgtcggtgacagattaatgtcattgtgactatttaattgtcgtcgtgacccatcagcgttgcttaattaattgatgacaaattaaatgtcatcaatataatatgctctgcaattattatacaaagcaattaaaacaagcggataaaaggacttgctttcaacccacccctaagtttaatagttactgagactctagaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattatttacctcctgcgacagtcaatttgtcattatgaaaatacacaaaagctttttcctatcttgcaaagcgacagctaatttgtcacaatcacggacaacgacatctattttgtcactgcaaagaggttatgctaaaactgccaaagcgctataatctatactgtataaggattttactgatgacaataatttgtcacaacgacatataattagtcactgtacacgtagagacgtagcaatgctccatggtatatctccttattaaagttaaacaaaattatttctacaggggaattgttatccgctcacaattcccctatagtgagtcgtattaatttcctaatgcaggagtcgcataagggagagcgtcgagatcccggacaccatcgaatggcgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagagcggttcagtagaaaagatcaaaggatcttcttgagatcctttttttctgcgcgtaatcttttgccctgtaaacgaaaaaaccacctggggaggtggtttgatcgaaggttaagtcagttggggaactgcttaaccgtggtaactggctttcgcagagcacagcaaccaaatctgtccttccagtgtagccggactttggcgcacacttcaagagcaaccgcgtgtttagctaaacaaatcctctgcgaactcccagttaccaatggctgctgccagtggcgttttaccgtgcttttccgggttggactcaagtgaacagttaccggataaggcgcagcagtcgggctgaacggggagttcttgcttacagcccagcttggagcgaacgacctacaccgagccgagataccagtgtgtgagctatgagaaagcgccacacttcccgtaagggagaaaggcggaacaggtatccggtaaacggcagggtcggaacaggagagcgcaagagggagcgacccgccggaaacggtggggatctttaagtcctgtcgggtttcgcccgtactgtcagattcatggttgagcctcacggctcccacagatgcaccggaaaagcgtctgtttatgtgaactctggcaggagggcggagcctatggaaaaacgccaccggcgcggccctgctgttttgcctcacatgttagtcccctgcttatccacggaatctgtgggtaactttgtatgtgtccgcagcgc

SEQ ID NO: 1643 - DNA, 8115 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttataagaaggagatatacatatgaacagtcagcaaaatcctgatttagctgttcatcccttggcaattcctatggaaggcttactaggagaaagtgctacaactcttgagaagaatgtaattgccacacaactctcagaggaagcccaagtaaagctagaggtaatccaaagtttactggaaccctgcgatcgcacaacttatgggcaaaagttgcgggaagcagcagagaaactaaatgtatcgttgcgaacggtacaaaggttggtgaaaaactgggaacaagatggcttagtcggcctcactcaaacaagtagggctgataaaggaaaacaccgcattggtgagttttgggaaaacttcattaccaaaacctacaaggagggtaacaagggaagtaaacgtatgacccctaaacaagttgctctcagagtcgaggctaaagcccgtgaattaaaagactctaagccgcccaattacaaaaccgtgttacgggtattagcacccattttggaaaagcaacaaaaagccaagagtatccgcagtcctggctggagaggaactacgctttcggttaaaacccgtgaaggaaaagatttatcggttgattacagtaaccatgtttggcaatgtgaccatacccgcgtggatgtgttgctggtagatcaacatggtgaaattttaagtcgtccctggctaacaacagtaattgatacttactctcgttgcattatgggtatcaacttgggctttgatgcacccagttctggggtagtagcattagcgttacgccatgcaattctaccaaagcgttacggttccgagtacaaactgcattgtgagtggggaacctatggaaaaccagaacatttttatactgatggcggtaaagactttcgctctaaccacttgagtcagattggggcgcagttgggatttgtctgtcatttacgcgatcgcccttctgaaggtggagtagtagaacgtcccttcaaaacattaaatgaccaactattttcaacgcttcctgggtacaccggatctaatgtgcaggaacgcccagaagatgcagagaaggacgcaagacttactttgcgagaactagaacagttacttgtgcgttacatcgtagatcgttacaaccaaagtattgatgcgcggatgggcgaccaaacgcgctttgagcgttgggaagcaggattgcctacagtgccagtaccaataccagaacgagatttggatatttgtttaatgaagcagtcacggcgcactgtgcaaagaggtggttgtttgcagtttcagaatttaatgtatcggggggagtatttggcaggttatgccggagaaactgtcaacttgaggtttgaccccagagacattacaacaattttggtttatcgccaggaaaacaatcaggaagtatttctgactcgcgctcacgctcaaggtttggagacagagcaactggcattagatgaggctgaggcagcaagtcgcagactccgtaccgcagggaaaactatcagtaaccaatcattattgcaagaagttgttgaccgcgatgctcttgtcgctaccaagaaaagccgtaaggagcgtcaaaaattggaacagactgttttgcgatctgctgctgttgatgaaagtaatagagaatccttgccttctcaaatagttgaaccagatgaagtggaatctacagaaacggttcactctcaatacgaggacattgaggtgtgggactatgaacaacttcgtgaagaatatgggttttaaacaatgacagaagctcaggcgatcgccaagcagttgggtggggtaaaaccggatgatgagtggttacaagctgaaattgctcgtctcaagggtaagagcattgtgcctttacagcaggtaaaaactctccatgattggttagatggcaagcgcaaggcaagaaaatcttgccgagtagttggggaatcgagaactggcaagacagttgcttgtgatgcctacagatacaggcacaaacctcagcaggaagctggacgaccgccaactgtgcctgtcgtttatattcgacctcaccaaaaatgtggccccaaggatttgtttaaaaagattactgagtacctcaagtatcgggtaacaaaagggactgtatctgattttcgagataggacgatagaagtactcaagggttgtggcgtagagatgctaattattgatgaagctgaccgtctcaagcctgaaacttttgctgatgtgcgagatattgccgaagatttaggaattgctgtggtactggtaggaacagaccgtttggatgcggtaattaagcgggatgagcaggttctcgaacgctttcgggcgcatcttcgctttggtaaattgtcgggagaggattttaagaacaccgtagaaatgtgggaacaaatggttttgaaactgccagtatcttctaatctaaagagcaaggagatgctacggattctcacgtcagcaactgaaggctacattggtcgccttgatgagattcttagggaagctgcaattcgttccttatcaagaggattgaagaagattgacaaggctgttttacaggaagtagctaaggagtacaaatgatagaagcaccagatgttaaaccttggctattcttgattaaaccctatgaaggggaaagcctgagccactttcttggcaggttcagacgtgccaaccatttatccgcaagtggattgggtactttggcaggaattggtgctatagtggcacgttgggaaagatttcattttaatcctcgccctagtcagcaagaattggaagcgatcgcatctgtagtagaagtggatgctcaaaggttagcccagatgttaccgcctgctggagtgggaatgcagcatgagccaattcgcttgtgtggggcttgttatgccgagtcgccttgtcaccgaattgaatggcagtacaagtcggtgtggaagtgcgatcgccatcaactcaagattttagcaaagtgtccaaactgtcaagcaccttttaaaatgcctgcgctgtgggaggatgggtgctgtcacagatgtaggatgccgtttgcagaaatggcaaagctacagaaggtttgatgataaaaccagaaaaaggtcttaaataaggagatataccatgagtcaaataactattcaagctcgacttatttcctttgaatcaaaccgccaacaactctggaagttgatggcagatttaaacacgccgttaattaacgaactgctttgccagttaggtcaacaccccgacttcgagaagtggcaacaaaagggtaaactcccgtctaccgttgtgagccagttatgtcaacctctcaaaactgaccctcgctttgcaggtcagcccagccgtttatatatgtcggcaattcatattgtggactacatctacaagtcctggctggctatacagaaacggcttcaacagcagctagatggaaagacgcgctggctagaaatgctcaatagcgatgctgaattagtagaacttagtggtgacactttagaggctattcgtgtcaaagctgctgaaattttggcaatagctatgccagcatctgagtcagatagcgcttcacctaaagggaaaaaaggtaaaaaggagaaaaaaccctcatcttctagccctaagcgtagtttatccaagacattatttgacgcttaccaagaaacggaagatattaagagccgtagcgccatcagctacctgttaaaaaatggctgcaaacttactgacaaagaagaagattcagaaaaatttgctaaacgtcgtcgtcaagttgaaatccaaattcaaaggcttaccgaaaagttaataagtcgcatgcctaaaggtcgagatttgaccaatgctaaatggttagagacactcttgactgctacaaccactgttgctgaagataacgcccaagccaaacgctggcaggatattctgttgactcgatcaagttctctcccattcccccttgtttttgaaaccaacgaggatatggtttggtcaaagaatcaaaagggtaggctgtgtgttcacttcaatggcttgagcgatttaatttttgaggtgtactgcggcaatcgtcaacttcactggtttcaacgcttcctagaagatcaacagactaaacgcaaaagcaaaaatcagcattctagcggcttgttcacactcagaaatggtcatctagtttggcttgaaggtgagggtaaaggggaaccttggaatcttcaccacttgaccctttactgctgtgttgacaatcgcttgtggacagaggagggaacagaaatcgttcgccaagagaaagcagatgaaattactaaattcatcacaaacatgaagaagaaaagcgatctaagcgatacacagcaggctttgattcaacgtaaacaatcaacacttactcgaataaacaattcctttgagcgtcctagccaacccctttatcaaggtcaatcacacattttggttggcgtaagcctgggactagaaaaacctgccacagtagcagtagtagatgcgatcgccaacaaagtcttggcttaccggagtattaaacaattacttggcgacaattacgaactgctaaatcgccagagacgacaacagcagtacctatctcacgaacgccacaaagcacaaaaaaacttctctcccaatcaatttggagcatctgagttagggcaacatatagacagattattagctaaagccattgtagcgttagcgagaacctacaaagctggcagtattgtcttgcccaagttaggggatatgcgggaggttgtccaaagtgaaattcaagctatagcagaacaaaaatttcccggttatattgaaggtcagcaaaaatatgccaaacagtaccgggttaatgttcatcggtggagctacggcagattaattcaaagcattcaaagtaaagcagctcaaacaggaattgtgattgaggagggaaaacaacctattcgaggtagtccccacgacaaagcaaaggaattagcactttctgcttacaatctccgcctaactaggcgaagctaacaaatatctgaaccttgataatagaacattaatagcgccgcaattcatgcttgacagctagctcagtcctaggtataatactagtatattaatagcgccgcaattcatgctgcttgcagcctctgaattttgttaaatgagggttagtttgactgtataaatacagtcttgctttctgaccctggtagctgctcaccctgatgctgctgtcaatagacaggataggtgcgctcccagcaataagggcgcggatgtactgctgtagtggctactgaatcacccccgatcaagggggaaccctccaaaaggtgggttgaaagcggtcttctcgacgagaagacacgtgaatttttttgttcagaacgctcggtcttgcacaccgggcgttttttctttgtgagtccagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 1644 - DNA, 23 bp, Artificial Sequence
  Synthetic
cggtcttctcgacgagaagacac

SEQ ID NO: 1645 - DNA, 23 bp, Artificial Sequence
  Synthetic
atgccgatcgcgtcacactacgt

SEQ ID NO: 1646 - DNA, 23 bp, Artificial Sequence
  Synthetic
gccactcgctttaatgatgattt

SEQ ID NO: 1647 - DNA, 37 bp, Artificial Sequence
  Synthetic
gtttcaacaaccatcccggctaggggtgggttgaaag

SEQ ID NO: 1648 - DNA, 372 bp, Artificial Sequence
  Synthetic
  misc_feature (350)..(372): n is a, c, g, or t
gtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctccaaaaggtgggttgaaagnnnnnnnnnnnnnnnnnnnnnnn

SEQ ID NO: 1649 - DNA, 463 bp, Artificial Sequence
  Synthetic
  misc_feature (241)..(250): n is a, c, g, or t
tgtacattcgcaaattaaatgtcgtaattcgcaaatttgtgtcgtttttcgcaaattaatgtcgtttagaatagtttgtctcatcaattcaattataggaacttttcgcaaattaatgtcgtcctgtttctccatttagtgtcgattaacaaattaatgtcgctgttaacgaattaatgtcgtcgaattagttccaactaacgttaacaaattaatgtcgtctaacataatgtcttgctannnnnnnnnnaaaatgcgacatctaatttgcgaaacaggcaaatcttaataaacgacatttaatttgcgaaaataggatttgcgacatctaatttgcgaaacaggcaaattactcagttttatggataaatagcttgtaagtcctacgcaataaagatctcagctattagaagtaattgcgacactaatttgcgaattgcgacatataatttgcgaatgtaca

SEQ ID NO: 1650 - DNA, 18 bp, Artificial Sequence
  Synthetic
taaggaatattgttgata

SEQ ID NO: 1651 - DNA, 18 bp, Artificial Sequence
  Synthetic
catcaacaaatatgacag

SEQ ID NO: 1652 - DNA, 18 bp, Artificial Sequence
  Synthetic
gatacacacatgttgatg

SEQ ID NO: 1653 - DNA, 18 bp, Artificial Sequence
  Synthetic
tatcaacatctctctttt

SEQ ID NO: 1654 - RNA, 60 nt, Artificial Sequence
  Synthetic
  misc_feature (9)..(40): n is a, c, g, or u
cugauaacnnnnnnnnnnnnnnnnnnnnnnnnnnnnnnnngugaacugccgaguagguag

SEQ ID NO: 1655 - DNA, 50 bp, Artificial Sequence
  Synthetic
ccagtacagcgcggctgaaatcatcattaaagcgagtggcaacatggaaa

SEQ ID NO: 1656 - DNA, 50 bp, Artificial Sequence
  Synthetic
tttccatgttgccactcgctttaatgatgatttcagccgcgctgtactgg

SEQ ID NO: 1657 - DNA, 34 bp, Artificial Sequence
  Synthetic
ccagtacagcgcggctgaaatcatcattaaagcg

SEQ ID NO: 1658 - DNA, 34 bp, Artificial Sequence
  Synthetic
cgctttaatgatgatttcagccgcgctgtactgg

SEQ ID NO: 1659 - DNA, 45 bp, Artificial Sequence
  Synthetic
cataacaggaagaaaaatgccccgctgtgggcggacaaaatagtt

SEQ ID NO: 1660 - DNA, 45 bp, Artificial Sequence
  Synthetic
tccgcccacacccgcttacgcagggcatccatttattactcaacc

SEQ ID NO: 1661 - DNA, 146 bp, Artificial Sequence
  Synthetic
tgttgatgcaaccataaagtgatatttaataattatttataatcagcaacttaaccacaaaacaaccatatattgatatcctcacaaaacaaccataagttgatatttttgtgaatcgagtatttcagcaaaactactgcagtaag

SEQ ID NO: 1662 - DNA, 127 bp, Artificial Sequence
  Synthetic
tgttgatacaaccataaaatgataattacacccataaattgataattatcacacccataaattgatattgcctcttcatggtctaaacttcagtaagtttacgacattttcatgaagaggtcatttc

SEQ ID NO: 1663 - DNA, 40 bp, Artificial Sequence
  Synthetic
  misc_feature (21)..(40): n is a, c, g, or t
attttatggttgttccaacannnnnnnnnnnnnnnnnnnn

SEQ ID NO: 1664 - DNA, 40 bp, Artificial Sequence
  Synthetic
  misc_feature (1)..(20): n is a, c, g, or t
nnnnnnnnnnnnnnnnnnnntgttggaacaaccataaaat

SEQ ID NO: 1665 - DNA, 40 bp, Artificial Sequence
  Synthetic
  misc_feature (21)..(40): n is a, c, g, or t
attttatggttgtatcaacannnnnnnnnnnnnnnnnnnn

SEQ ID NO: 1666 - DNA, 40 bp, Artificial Sequence
  Synthetic
  misc_feature (1)..(20): n is a, c, g, or t
nnnnnnnnnnnnnnnnnnnntgttgatacaaccataaaat

SEQ ID NO: 1667 - DNA, 40 bp, Artificial Sequence
  Synthetic
  misc_feature (1)..(20): n is a, c, g, or t
nnnnnnnnnnnnnnnnnnnntgttgatgcaaccataaagt

SEQ ID NO: 1668 - DNA, 40 bp, Artificial Sequence
  Synthetic
  misc_feature (21)..(40): n is a, c, g, or t
actttatggttgcatcaacannnnnnnnnnnnnnnnnnnn

SEQ ID NO: 1669 - DNA, 40 bp, Artificial Sequence
  Synthetic
  misc_feature (1)..(20): n is a, c, g, or t
nnnnnnnnnnnnnnnnnnnntgttggagcaaccataaagt

SEQ ID NO: 1670 - DNA, 40 bp, Artificial Sequence
  Synthetic
  misc_feature (21)..(40): n is a, c, g, or t
actttatggttgctccaacannnnnnnnnnnnnnnnnnnn

SEQ ID NO: 1671 - protein, 15 aa, Artificial Sequence
  Synthetic
GGSGGSGGSGGSGGS

SEQ ID NO: 1672 - DNA, 74 bp, Artificial Sequence; identical to SEQ ID NO: 915
  Synthetic

SEQ ID NO: 1673 - DNA, 74 bp, Artificial Sequence; identical to SEQ ID NO: 916
  Synthetic

SEQ ID NO: 1674 - DNA, 130 bp, Artificial Sequence; identical to SEQ ID NO: 954
  Synthetic

SEQ ID NO: 1675 - DNA, 130 bp, Artificial Sequence; identical to SEQ ID NO: 1297
  Synthetic

SEQ ID NO: 1676 - DNA, 130 bp, Artificial Sequence; identical to SEQ ID NO: 1346
  Synthetic

SEQ ID NO: 1677 - DNA, 130 bp, Artificial Sequence; identical to SEQ ID NO: 1418
  Synthetic

SEQ ID NO: 1678 - DNA, 130 bp, Artificial Sequence; identical to SEQ ID NO: 1443
  Synthetic

SEQ ID NO: 1679 - DNA, 129 bp, Artificial Sequence
  Synthetic
ctgttgatacaaccaaaaatgataattacacccataaattgataattatcacacccataaattgatattgcgatttaggagttgatttaatcaactttagtggaccaatcacgtgatcatggatggtag

SEQ ID NO: 1680 - DNA, 5 bp, Artificial Sequence
  Synthetic
aaaat

SEQ ID NO: 1681 - DNA, 5 bp, Artificial Sequence
  Synthetic
ctatt

SEQ ID NO: 1682 - DNA, 5 bp, Artificial Sequence
  Synthetic
aaatc

SEQ ID NO: 1683 - DNA, 5 bp, Artificial Sequence
  Synthetic
caaaa

SEQ ID NO: 1684 - DNA, 5 bp, Artificial Sequence
  Synthetic
aatag

SEQ ID NO: 1685 - DNA, 5 bp, Artificial Sequence
  Synthetic
gttgt

SEQ ID NO: 1686 - DNA, 5 bp, Artificial Sequence
  Synthetic
cgaac

SEQ ID NO: 1687 - DNA, 5 bp, Artificial Sequence
  Synthetic
tagtt

SEQ ID NO: 1688 - DNA, 5 bp, Artificial Sequence
  Synthetic
taaac

SEQ ID NO: 1689 - DNA, 5 bp, Artificial Sequence
  Synthetic
ttatt

SEQ ID NO: 1690 - DNA, 5 bp, Artificial Sequence
  Synthetic
taaaa

SEQ ID NO: 1691 - DNA, 5 bp, Artificial Sequence
  Synthetic
gtatt

SEQ ID NO: 1692 - DNA, 5 bp, Artificial Sequence
  Synthetic
aaatt

SEQ ID NO: 1693 - DNA, 5 bp, Artificial Sequence
  Synthetic
ctact

SEQ ID NO: 1694 - DNA, 5 bp, Artificial Sequence
  Synthetic
agatg

SEQ ID NO: 1695 - DNA, 5 bp, Artificial Sequence
  Synthetic
tgaaa

SEQ ID NO: 1696 - DNA, 5 bp, Artificial Sequence
  Synthetic
agaac

SEQ ID NO: 1697 - DNA, 5 bp, Artificial Sequence
  Synthetic
aaaag

SEQ ID NO: 1698 - DNA, 5 bp, Artificial Sequence
  Synthetic
gcttt

SEQ ID NO: 1699 - DNA, 5 bp, Artificial Sequence
  Synthetic
ttttt

SEQ ID NO: 1700 - DNA, 5 bp, Artificial Sequence
  Synthetic
ttggg

SEQ ID NO: 1701 - DNA, 5 bp, Artificial Sequence
  Synthetic
cccaa

SEQ ID NO: 1702 - DNA, 5 bp, Artificial Sequence
  Synthetic
aagag

SEQ ID NO: 1703 - DNA, 5 bp, Artificial Sequence
  Synthetic
agctt

SEQ ID NO: 1704 - DNA, 5 bp, Artificial Sequence
  Synthetic
aattt

SEQ ID NO: 1705 - DNA, 5 bp, Artificial Sequence
  Synthetic
attcc

SEQ ID NO: 1706 - DNA, 5 bp, Artificial Sequence
  Synthetic
cgcta

SEQ ID NO: 1707 - DNA, 5 bp, Artificial Sequence
  Synthetic
ccatc

SEQ ID NO: 1708 - DNA, 5 bp, Artificial Sequence
  Synthetic
taagg

SEQ ID NO: 1709 - DNA, 5 bp, Artificial Sequence
  Synthetic
cttta

SEQ ID NO: 1710 - DNA, 5 bp, Artificial Sequence
  Synthetic
taaag

SEQ ID NO: 1711 - DNA, 5 bp, Artificial Sequence
  Synthetic
catct

SEQ ID NO: 1712 - DNA, 5 bp, Artificial Sequence
  Synthetic
gatgg

SEQ ID NO: 1713 - protein, 273 aa, Escherichia coli strain K-12
MAKANSSFSEVQIARRIKEGRGQGHGKDYIPWLTVQEVPSSGRSHRIYSHKTGRVHHLLSDLELAVFLSLEWESSVLDIREQFPLLPSDTRQIAIDSGIKHPVIRGVDQVMSTDFLVDCKDGPFEQFAIQVKPAAALQDERTLEKLELERRYWQQKQIPWFIFTDKEINPVVKENIEWLYSVKTEEVSAELLAQLSPLAHILQEKGDENIINVCKQVDIAYDLELGKTLSEIRALTANGFIKFNIYKSFRANKCADLCISQVVNMEELRYVAN

SEQ ID NO: 1714 - protein, 282 aa, Enterobacter cloacae strain e1713
MTRGRRFTSFESYEKALRDGIGLGAGENYQPWIRPQDFTNSTGIRSAIRGLKTFRQHNTLSGIESEFYYLAEFNDSVIDIREQFPLLPVTLTQNIANILNVPHPALRRKVCDTDKPAVPAVMTTDFVLTFRNQDGTIKYKSYSVKPDEIISKRDAEKQEIERVFWEGINVCFQIYTGSEVTRIKSGNISWFTAPFRMNGLPDYHLDVSLLREFPPGQYVLLHMVKKIASSLSISTDDAFIVLKFMLATKSIEVDLTSDIVSNGCIVVLRNSACDMGLAYENN

SEQ ID NO: 1715 - protein, 275 aa, Aeromonas salmonicida strain BG
MAKSQQSLSELQIVRRIKDGRGQGFGKQYRPWLYVQDVPSEGRSHRIYSHKTGRVHHLLSDLELAAFLVFEWSPDIADIREQFPLRREDTRAIAAEHRLRHPSVRGVDQVMSSDFLVDTDNGLHRQFAVQVKPMEALSDVKIIEKLELERRYWQLKQVPWFLITEHEIDPVIRQNVEWLYPTKTEGLVEPGLLAQLPLLYRTFSKAPETKVIDICKRIDTAYDLELGHTLRDVRTLIANGFLKFNIHKVFRTITAAELIFCQFNDMEALLHVANQ

SEQ ID NO: 1716 - protein, 273 aa, Proteus mirabilis; identical to SEQ ID NO: 1713

SEQ ID NO: 1717 - protein, 702 aa, Escherichia coli strain K-12
MWQINEVVLFDNDPYRILAIEDGQVVWMQISADKGVPQARAELLLMQYLDEGRLVRTDDPYVHLDLEEPSVDSVSFQKREEDYRKILPIINSKDRFDPKVRSELVEHVVQEHKVTKATVYKLLRRYWQRGQTPNALIPDYKNSGAPGERRSATGTAKIGRAREYGKGEGTKVTPEIERLFRLTIEKHLLNQKGTKTTVAYRRFVDLFAQYFPRIPQEDYPTLRQFRYFYDREYPKAQRLKSRVKAGVYKKDVRPLSSTATSQALGPGSRYEIDATIADIYLVDHHDRQKIIGRPTLYIVIDVFSRMITGFYIGFENPSYVVAMQAFVNACSDKTAICAQHDIEISSSDWPCVGLPDVLLADRGELMSHQVEALVSSFNVRVESAPPRRGDAKGIVESTFRTLQAEFKSFAPGIVEGSRIKSHGETDYRLDASLSVFEFTQIILRTILFRNNHLVMDKYDRDADFPTDLPSIPVQLWQWGMQHRTGSLRAVEQEQLRVALLPRRKVSISSFGVNLWGLYYSGSEILREGWLQRSTDIARPQHLEAAYDPVLVDTIYLFPQVGSRVFWRCNLTERSRQFKGLSFWEVWDIQAQEKHNKANAKQDELTKRRELEAFIQQTIQKANKLTPSTTEPKSTRIKQIKTNKKEAVTSERKKRAEHLKPSSSGDEAKVIPFNAVEADDQEDYSLPTYVPELFQDPPEKDES

SEQ ID NO: 1718 - protein, 673 aa, Enterobacter cloacae strain e1713
MILYELNDNKITRPKLFYIEPFKLGVQERNIVHFNYPIPVWMMATDNDIPDKNRIRRDKNFALISPLLSDPDFLFLYALNERSPLLRNYAKDNNASYSTIKKLLSNCWKYGRGKQSLTPAYARSGGNGVKKTVKSVSVGRKKKGRALIDGRAETYIMRERDSANIKKILKRHYLKPKGKSQAECWRIYLEEYFPQLASITQDCAISYPSLAQFRYCITKLFSLTEIARRRTTERDFLLNKRALAGSSADSDTLPGSVFEIDATVADVHLVSELTGDVVGRPTVYLVADRATRMITGMHVSYLYASWRAASQALANCFSPKGQYCRLFGVNDISDDRWPCSHVPTKLLCDNAEMLGLKTQSAVVPFTELMFAPSYRADLKGVVESRFRILNQKAIHKLLGTTRGGFVVRGETRPQLRSCYTLKAFTEIIIRAVDEYNHALNTELLYINPLLLEHNLIATPVNSWNISINNFRFGGYQITEHEIISRLLYPDSASITGKGIQYGNRFYECSEDEMVGARSFGQTRVDVRINDNSMDKIYIRSGKDTVFSQRELLSRRKIFQGLPHMEAEVVSDIVDMHKSSNVITPESMALRKLIEANEQEGEILLAALRKKGRGRYKNIRENRRKEVLYAQQGDSRKTSENYKLPPANNIVILPGPEARKAWLTKQNDPYKKDK

SEQ ID NO: 1719 - protein, 697 aa, Aeromonas salmonicida strain BG
MWQINEVLRFDGQHYRILAVNSGEIVWICLDLDTAQPERRTELELISYFDEERLFRHVDPFASIDLEEPLVGSVAFNKRERGLLIIQPIIADELCFEPRIRARRVEQVRQSGMASIATIYKLLRRYWQRGQKPNSLLPDYKNSGAPGKTRAASGQAKIGRSRKFGDGEGMKVTPDIERLFRLTIEKHILSVDGLKTTVAYRRFSDLFKQYYPQVEEANRPTIRQFRYFYDREYKKPQRLEARTHPGVYKKDVRPLTSTATASVLGPGSRYEIDATIADIYLVDDEDRSKIIGRPTIYIVIDVFSRMTSGFYIGFDNPSYVVAMQAVVNACIDKTNICAQLGVDVSPDEWPCIGLPDVILADRGEMMSHQVDALISGFNLRIESAPPRRGDAKGIVESCFRTLQAEFKPYVPGVVVGNRVKKHGERDYRLDAVMPISDFSQIILRTILFRNNYHVLDKYDRDADLPADLPSIPRDLWNWGMQHRVGGLRQVDPLQLQVALLPRRKVSVSPFGVNMWGLYYSGTDLLREGWLHRSTEINRPESLEAAYDPASADTIYLFPQAGSRIYWECSLTDRSRQFRGLTFWQVWDIQAEEKHNKANAKLIEDAKRRELDAFIKSKTVDAIKQSPSVTEPDQQRIQQIRSNKKSARDAERQNRTKSVTVDPGKPLADVVPLKPADDDYSFPHFVPELFDDGQGDAE

SEQ ID NO: 1720 - protein, 702 aa, Proteus mirabilis; identical to SEQ ID NO: 1717

SEQ ID NO: 1721 - protein, 555 aa, Escherichia coli strain K-12
MSATRIQAVYRDTGVEAYRDNPFIEALPPLQESVNSAASLKSSLQLTSSDLQKSRVIRAHTICRIPDDYFQPLGTHLLLSERISVMIRGGYVGRNPKTGDLQKHLQNGYERVQTGELETFRFEEARSTAQSLLLIGCSGSGKTTSLHRILATYPQVIYHRELNVEQVVYLKIDCSHNGSLKEICLNFFRALDRALGSNYERRYGLKRHGIETMLALMSQIANAHALGLLVIDEIQHLSRSRSGGSQEMLNFFVTMVNIIGVPVMLIGTPKAREIFEADLRSARRGAGFGAIFWDPIQQTQRGKPNQEWIAFTDNLWQLQLLQRKDALLSDEVRDVWYELSQGVMDIVVKLFVLAQLRALALGNERITAGLLRQVYQDELKPVHPMLEALRSGIPERIARYSDLVVPEIDKRLIQLQLDIAAIQEQTPEEKALQELDTEDQRHLYLMLKEDYDSSLLIPTIKKAFSQNPTMTRQKLLPLVLQWLMEGETVVSELEKPSKSKKVSAIKVVKPSDWDSLPDTDLRYIYSQRQPEKTMHERLKGKGVIVDMASLFKQAG

SEQ ID NO: 1722 - protein, 487 aa, Enterobacter cloacae strain e1713
MAVNAKYHQADLPEYRGNPLIEALPPLMSREDVMLALSNFPEINANERELSTEVREQYVDRIDAFRCPQGTFFDCYKAIVRLLRTGYTTRNPLDIHTVRFLHYSVEGSLGEALGDGFHRPRAGTFSITGISGVGKSTMLEQVLGHFPQIIDHNVYQGHDLTPLRLVVWLKINCPPNSKARDLTEILLTAIDDALGLERTAPPSRTGTLLRLIAQKIKSAFIGVLVIDEMQRLTRTNGDEQLINFLHDIVDTLGVPLVFCGNPEFEDKMRQRLRFARRAETAGFIRLNPLAYQTTDWQSFIQYLWRYQWTNVYTPLNDELNIKMHKLSKGNLAIAQRLFVTAQLKVIGTGNEVITPALLGLSESVLTSRADEFIQADALIYDVELPELSESEETVLPQKNNGKSFLKSREIRQKPARRVHKSFTVTADLNRPQHEEFAEELNNYTAQTEAILAKRCEPVLFRALWQNKCRYSALEHYDRLCNDPSTET

SEQ ID NO: 1723 - protein, 552 aa, Aeromonas salmonicida strain BG
MSASKIKAIYRDTGVSAYTGNPFIEALPPLQESVDSANALRSNMLFHPEDLQKARIVRAHNICRIADEFFQPLGAHMLLSERVSLMIRGGYVGRNPKTGDLQRHLQNGYERVQTGDLSTFRFEEAKSTAQSMLLIGCSGSGKTTSLGRILQTYPQVIYHAEFNFEQVVYLKVDCSHNGSLKEICLNFFRSLDKALGTNYEKTYGLKRRNGIETLLALMAQTANAHALGLLVIDEIQHLSRSRSGGSEEMLNFFVTMVNTIGVPVMLIGTPKARDIFEADLRSARRGAGLGAIFWEPMSLGHPDKPSQEWIAFTNNLWKLQLLQKRDVLLTDEIRAVWYDLSQGVMDIVVKLFVLAQLRALALNKERITVGLLRQVYEDELKPVHPMLAALRSGIPEKIAQYSDLMVPDMDKRLIQLQQNIAAMKEQTAEETALQQLATEDERRIYLLLKDVYDSPLLVATIRKAFTENPQLTISQLLPVVTQWLSQPAVKDATMPNVSQEKSTVIKADAWEQLPFDDLRYIKSQHKQAVDVHAELKSKGMLLDLKSVLARAS

SEQ ID NO: 1724 - protein, 555 aa, Proteus mirabilis; identical to SEQ ID NO: 1721

SEQ ID NO: 1725 - protein, 508 aa, Escherichia coli strain K-12
MRNFPVPYSNELIYSTIARAGVYQGIVSPKQLLDEVYGNRKVVATLGLPSHLGVIARHLHQTGRYAVQQLIYEHTLFPLYAPFVGKERRDEAIRLMEYQAQGAVHLMLGVAASRVKSDNRFRYCPDCVALQLNRYGEAFWQRDWYLPALPYCPKHGALVFFDRAVDDHRHQFWALGHTELLSDYPKDSLSQLTALAAYIAPLLDAPRAQELSPSLEQWTLFYQRLAQDLGLTKSKHIRHDLVAERVRQTFSDEALEKLDLKLAENKDTCWLKSIFRKHRKAFSYLQHSIVWQALLPKLTVIEALQQASALTEHSITTRPVSQSVQPNSEDLSVKHKDWQQLVHKYQGIKAARQSLEGGVLYAWLYRHDRDWLVHWNQQHQQERLAPAPRVDWNQRDRIAVRQLLRIIKRLDSSLDHPRATSSWLLKQTPNGTSLAKNLQKLPLVALCLKRYSESVEDYQIRRISQAFIKLKQEDVELRRWRLLRSATLSKERITEEAQRFLEMVYGEE

SEQ ID NO: 1726 - protein, 331 aa, Enterobacter cloacae strain e17132
MLLRAFPGEILFSRLCRSLSVSGLPVQKFSRSLGPEARSSFHPFLTQHLTEIAQTSHENAELLWAEQTLFPLWVWSMPGYAKALRQLTGPPARLLWFYQLTGNHSSQSMQLHFCPVCAREDAMEYGVPYWHCEHQIPGVSICNRHCCRLMPKLVPPSPHIAVEFYPDNFNTMILSKNIENDFAVFASQILTRLAHGEEISDNYLSGFTSTRTDVENMKHSGNEKLFLSLNDLIRHLWEENSDPVISDKSHFLYYIISHFENIFPAQKLLLLFYLQRMHSIRQNASREHTPLNKMNKDHTKNGIHKPVMELNNLMVRLWPSTKFIADLRTQT

SEQ ID NO: 1727 - protein, 506 aa, Aeromonas salmonicida strain BG
MRNFPVPYPDELVYSMVARAGIYHGITSPKQLLDEVFENRKVIATLDLPCHLQSISSLFQNTGRYSVEELVYQHTLFPLYAPFVTESHKSRALQMMAGRSQGAVHLMLGVAASRIQSSDRFRYCPECIKNQHQHYGEYFWQRNWFFPGLAVCPEHGPLSILTNGSGSHRHHFFAMTPQSPVDCELSSVNEELLRLAIYANKFLNISPGYSPDFEQWTSFYRDLASDFGFCRGRHINHGEIHERVHACFHPSTLTQLNLYTDSATETGWLKGIFRKHRKAFSYLEHAIIWQSFIAELEPEDVIDRVRKIKPCTKVVFEITASSTLSKNNEHLQVQRQTWQKLVLQYGVLNARNSRPGKALYAWLYRNDKCWLMAFNFEHKEQRTNPELKADWHRRDLVAIRQLRKLLQEIAPSYAGPRLSANFLLCKLQQSSTIEKNLDKLPLVRMFLQRYTETITEYQIRRLTNTCAEMQRQGEPLKKWLVMRKAGLSQERLRPDAQTVLNELQLF

SEQ ID NO: 1728 - protein, 508 aa, Proteus mirabilis; identical to SEQ ID NO: 1725

SEQ ID NO: 1729 - protein, 188 aa, Rhodanobacter sp. isolate FW106
MTTHYIDITVKPDPESSAAQLLGALYDKLHLALVQYGLNDIGVSFPGYSMNPRNLGTALRLHGTDHALRQLTQADWLKGVRDHVRVTDITEVPDGASHRTVRRKQFKTSAERLRRRRMRRKGETAEQAARAIPSSIERQPNLPYVHVRSQSTGQPFCLFVTLGAPAADATPGKFNGYGLSETTTIPWF

SEQ ID NO: 1730 - protein, 188 aa, Burkholderia plantarii strain PG1
MTTHFIDIRLLPDPEFSQVHVFGALVSKLHRVLVQMRRDDIGISFPEYSLRPRSVGRVLRLHGGDVGLRELMAQPWLQGMRDHVVVAEAAPVPAGATHRVVRRRQFKTNAERLRRRRMQRKGETAEQAAAHIPDSVERRPDLPYVQLRSTSTGQGFCLFVEQGNVGREAVAGAFNSYGLSQGATVPWF

SEQ ID NO: 1731 - protein, 189 aa, Idiomarina sp. H105
MDHYIDIRLRPDPDFPEAMLMGALYNKLHRALFDLQATDLGVSFPGHKHGVRARTLGSHLRLHGTHERLKQLMGMDWLTGMRDHTQVSAVLEVPAGAQHINVARKQFNTGSESRAKRYAKRHSISEEEARSIYSKVAARRIELPFVQINSRSTQQRFSLFIEHGKPAASSSEGSFSHYGLSPSATVPWF

SEQ ID NO: 1732 - protein, 187 aa, Pseudomonas aeruginosa strain X9820
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARTLDLPFVTLRSQSTGQHFRLFIRHGPLQATAEEGGFTCYGLSKGGSVPWF

SEQ ID NO: 1733 - protein, 341 aa, Rhodanobacter sp. isolate FW106
MTNELKTASVLAFERKLDPSDALLFAGNWAARTESQDWAPITLREKSVRGTISNRLKAGAQDPAKLDASIQNPNLQTVDVAALPADADTLKVQFTVRVLGGAGNPSACNDADYRHKLLATVGDYVQQHGFVELARRYAANLANGRFLWRNRIGAEQVEVQIAHIQDGEAASRWTFNALAHSMLDLAASADDTQSLSELATLIASGLAGESHVLLQIMAFVRVGAGQEVFPSQELILDKGSSKKSKTLYDVQSVAAIHSQKVGNALRTIDTWYPDAIENGPIAVEPYGSVTTQGKAYRQPKAKMDFYNLLDGWIIKDKVPDVDQQHFVIATLIRGGVFGEAS

SEQ ID NO: 1734 - protein, 341 aa, Burkholderia plantarii strain PG1
MAFMSEKLTTATVLAFERKLDPSDAIFHAGHWDDHDKASAWTPVEIREKSVRGTISNRLKTKEQDPAKLDAAIEKPNLQTVDVATLPSDADTLRVQFTLRVLSGAGTPSACNSAAYRAKLSSVVSAYVEQHGFAELANRYAANLANGRFLWRNRIGAESVRVEIARLRKGAAERTWTFDALSLNLRSIETPDAPLAELGELIADGLAGRTDVLLQVTAYVRLGRGQEVFPSQELILDKGSSRKSKTLYQVRDIAAIHSQKIGNAIRTIDSWYEGADELGPIAVEPYGSVTTQGKAYRQPKQKQDFYTLLDDWLLKDRIPPVEQQHFVLAVLIRGGVFGDAS

SEQ ID NO: 1735 - protein, 344 aa, Idiomarina sp. H105
MAKNDTLKTASVLAFERKLDPSDALFRAGQWEDRSQAAQWKLIPVREKSVRGTISNRLKAKDQDPAKVDAKIEDPNLQTVDVATLPHDADTLAVRFTLRVLAGAGTPSACNNAEYQKKLAQTVSGYVSEHGFDELAHRYACNLANGRFLWRNRIGAEEVEVVVSQMKEGQPEKTWTFDALEQSTRDFTGNAETRELGAVIAQALAGKQYLLLDVVAFARIGAGQEVFPSQELILDRSRGDKSKTLYSIGDEKQAAIHSQKLGNALRTIDTWYPAPEDGDTLGPIAVEPYGSVTTQGTAYRQPKQKVDFYNLLDNWLLKDQVPPVEQQHFVMATLIRGGVFGEAG

SEQ ID NO: 1736 - protein, 342 aa, Pseudomonas aeruginosa strain X9820
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNEQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 1737 - protein, 457 aa, Rhodanobacter sp. isolate FW106
MSELTDRGKTFRAAIAGFIEARREAKLKSKADDADTASKYDYATWLADAARRVGQIQAVTHVLKATHPDARGSSLHVAPSQLPQHVEIGSHLLGSDYAEDVVGNAAALDVFKLLKLDVDGRRLLDWAQAGDADLQAALSDAAEQAQGWMQAFTSLVREETQPTSHPMAKQLYWLAGENPQDDAQYHLLQPMFSSTLAHAVHADIQAARFGEINKEARQARRDNKPGEHPYRDYRGLVARKLGGTKPQNISQLNSERGGVNYLFASLPPPAWAPRQGPDLRKLDSVFDQIRGALFWFGEVREHLQVLADFLKTNPDQNKETRDRVAASVQAIGQELAMFGTAVQGRYPAGWTRDADCRLPRCEQLWLDPDRTELPLREDADYPQWHEDDVTFQQAYDRGDWADEVATRFGLWLNGQLRKRSDELAVLGESEMRHFARQAILDVAWPIPLQRRAKAGAA

SEQ ID NO: 1738 - protein, 457 aa, Burkholderia plantarii strain PG1
MSDSPAAPGNSSFRAAVDAFLRARLQAKLDKLPEDDPKRAGLIAEHQRTAWIPDAARRVRQIQAVTHSLKPIHPDARGTNLHVAPSDLPTLTDLGSHALGGRFALDVVGNAAALDVVKLLKVEHDGRTLLEALQADDAGALHSLADDAGEAAALRDAFLNLTEARDGAASSHVLAKQVYWLTGDDPSDDAQYHLLAPLYPTSLVQAVYDDVHDARFGEANKLARQARREGAPFDGVYREYRDLAVQKLGGTKPQNISQLNSERGGNNYLLSSLQPVWDSRLNHLPAHTDSIFDRPFTGRPEVRRTLNALRTFLSGDPSANLDTRTRRDALRDRLIDELVSYAGELLRHPAGWTREAPFADLNDDEKLWLDPLRAELPEEREFAVRWLAMEWPERIGARFGKWLNAQLRHELPDVGYHEAREWQRALLGDDSSWQEQLRRMRDALDHVHLSHVSTEGA

SEQ ID NO: 1739 - protein, 448 aa, Idiomarina sp. H105
MTEPPHQSLSLKELIHDFIQQRFATKTEKLAKDDPAYLKFQEQFAPQTWLADAARRVSQLQVVTHSLKPIHPDAKGTNLYVEPRTLDQGDLVGSHCLPDDFQGDVVGNAAALDVYKFLKLEWQGRSLLELALENDDTFIDALSKNPEEAQAWVSAFASIVEPKGAPSSHTRGKQMYWLVGDDPTDDASYHLLAPLYATALTHPFHARLSEARFGEHAKAGRKARRENVAFEGVYSDYLNLAVQKLGGTKPQNISQLNSERGGQNYLLASLPPHWQSHDIYPPMRDAFRAFKRRPTVWKTVHELKRFLETDPAKNMHTRDLRDDFITMLVDELMLFTFDMHSLAPGWTADDKCELGPEEQYWLDPGRALQDSEFDQARRRSPWHEAISDRAAAWLNRQLNYKSALSVGDLEHDHWQRQIEAVLKNFRRQLDDLQDALRDDDESFQGESA

SEQ ID NO: 1740 - protein, 433 aa, Pseudomonas aeruginosa strain X9820
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHGLLREARFGEAARAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRKYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 1741 - protein, 324 aa, Rhodanobacter sp. isolate FW106
MNACPNFTHLLVLPHLKVHNANAISSPLTHGFPSITAFLGLMWALERKTRAAGLDLEFGAVGVVCHSHQEQTTESGFVKAFRLTRNAVGKDGKTAAIVEEGRIHLDLSLVLAVHAGPWDQDAQRRDLKTIADLLQGMRIAGGTLLPAPQTQTSRHRPWLADLTGNSDDQANAFRKLRARLLPGSALVARDDLIDQRLRVLQAGTPEPTRLDAWLSLCRINWYYDMQAEGGTGAWQNDRTKGSGWVVPIPVGYGALGDLHEAGSVPNARDASTPFRFVESLYSMGEWIGPHRLHSPQDLLWYADSHPDDGLYRCRNDYHTVNTNL

SEQ ID NO: 1742 - protein, 349 aa, Burkholderia plantarii strain PG1
MSDIEALLVLPHLQIQNANAISSPLTHGFPSITAMTGLMWALQRKLAGAGIPLKLRRVGVICHDFDEQVQDGYVKTFRLTRNPVDKDGATAAIVEQGRMHLDLTLLFDVVDAGTAGDAPSSGLRDDTGRNEWATRIGEIVAGMRVAGGSVLPGRAIPGRRTRPWIATLPDDYEEQLRLFARWRRQWLPGYALVGRDDLLAERHRLLREQGDDASLLDAWLHAARFNHQPLPDESAGSGADAAKRLRWGDPLRPRGSGWIVPIPVGYTALTKPHAPGAVANTRDAATPFVWVESIYSLGQWISPHRVTHWHELLWQPETDGKAGLYRCRSGYQGPAGANEPGDDDLPDFD

SEQ ID NO: 1743 - protein, 327 aa, Idiomarina sp. H105
MINHLLVLPRLRIQNANTISSPMTWGFPSMSAFVGVQQVLERNLPDDIKLVFNEIGVVCHHIDPQVTEGGFIKAFHLTRNPVDKSGGTAAIVEEGRAHLEISLLIGVESDGDDLGSPERCRVIAQTLFDQVQGMRIAGGSVIPALNAQQRYRPELVSFDVNESERAKQWQRLKRRLLPGFALVLRDDLLTKHTATLKAQNSSATALDAWLDLSRLNHECHVEQVKDEKDGKEKEVVQWSIRRPYPGWLVPIPVGYGAISDLYAPGDVANARNAEVPFRFVESLYSMGEWVSPHRFQKPDDLMWFVENDLDRGIYRLQNDYANTLTED

SEQ ID NO: 1744 - protein, 327 aa, Pseudomonas aeruginosa strain X9820
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRTHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVATLSDLLWYHHAEPDKGLYRWSTPRFVEHAIA

SEQ ID NO: 1745 - DNA, 13401 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaactaccgagcgcagcgagtcagtgagcgaagctttgttgatacaaccataaaatgataattacacccataaattgataattatcacacccataaattgatattgcctcttcatggtctaaacttcagtaagtttacgacattttcctcgaaccgtattaccgcctttgagtgagctgataccgctcgccgcagccgaacgaccgagcgcagcgagtcagtgagcgaggacacaagctttgacagctagctcagtcctaggtataatactagcgtcgacgtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1746 - DNA, 13381 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaactaccgagcgcagcgagtcagtgagcgaagctttgttgatacaaccataaaatgataattacacccataaattgataattatcacacccataaattgatattgcctcttcatggtctaaacttcagtaagtttacgacattttcctcgaggtcatttccggggcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1747 - DNA, 12828 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaacgaccgagcgcagcgagtcagtgagcgaggacacaagctttgacagctagctcagtcctaggtataatactagcgtcgacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1748 - DNA, 12828 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaacgaccgagcgcagcgagtcagtgagcgaggacacaagcttttatggctagctcagtcctaggtacaatgctagcgtcgacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1749 - DNA, 12949 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaactaccgagcgcagcgagtcagtgagcgaggacacagcggattgcattaggttttagtttcttgtataatgcttaatgttggtcactgacaggctacgatacggaaggttgctcacgcccggcccctttgccatggctagtgtgtggaaatttccgaggagcaagtctatttccaaaaatgggcgaaaaaggaggtaatacagtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1750 - DNA, 12874 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1751 - DNA, 12980 bp, Artificial Sequence
  Synthetic
gctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatactccttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcagaatttcagataaaaaaaatccttagctttcgctaaggatgatttctggtggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataactcgacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcgtataatctagtagctgcggaatcgacgttttagagctagaaatagcaagttaaaataaggctagtccgttatcaacttgaaaaagtggcaccgagtcggtgctttttttataaaacgaaaggctcagtcgaaagactgggcctttcgttttatccgaatacgggttcttgcatgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcccgggagatctgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtccctagtgcttggattctcaccaataaaaaacgcccggcggcaaccgagcgttctgaacaaatccagatggagttctgaggtcattactggatctatcaacaggagtccaagcgagctctcgaaccccagagtccc

SEQ ID NO: 1752 - DNA, 14340 bp, Artificial Sequence
  Synthetic
cacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgagaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactggg

SEQ ID NO: 1753 - DNA, 12747 bp, Artificial Sequence
  Synthetic
tttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccagttcaccgacaaacgaaagctgataatctcatgaccaaaatcccttaacgtgagttttcgttccactgagcgtcagaccccgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgattgcggccgcaaccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatacccatggattcttcgtctgtttctactggtattggcacaaacctgatatcgatgcaggtggcacttttcggggaaatgtgcgcggaacccctatttgtttatttttctaaatacattcaaatatgtatccgctcatgagacaataaccctggtagcgaccgagtgagctagctatttgtttatttttctaaatacattcaaatatgtatccgctcatgagacaataaccctgataaatgcttcaataatattgaaaaaggaagagtatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtcctgtcagaccaagtttactcatatatactttagattgatttaaaacttcatttttaatttaaaaggatctaggtgaagatccgcctgcatggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattccctcgacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacc

SEQ ID NO: 1754 - DNA, 3453 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 1755 - DNA, 12612 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttgatacaaccataaaatgataattacacccataaattgataattatcacacccataaattgatattgcctcttcatggtctaaacttcagtaagtttacgacattttcctcgaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtagtcttcagagatggggatgctgttgattgtagccgttgctctttcaatgagggtggattcttcttgagacaaaggcttggccatcggtccaggattctcttcgacatctccggcttgtttcagcagagagaagtttgttgcgccggatccggcatagtcggggacatcatatgggtatgcataatcaggcacgtcgtagggataagcgtaatctggaacatcgtatgggtatttcttcttcttagcctgtccagccttctttgtggcggcaggtcgcttggatcccttgtacagctcatccataccgagagtgatgcctgcggcagtcacaaattccagaaggaccatgtgatctctcttttcgtttgggtccttggaaagctttgattgcgtggagagataatgattgtcaggcaagagtacaggtccatctccgatgggcgtattttgttggtaatgatcagccagttgaacactaccatcttcgacattatgtcggatcttaaagttggcctttatcccatttttctgcttatcagcggtaatatacacattatggctgttaaagttgtactccaacttgtgccccagtatgttaccgtcctccttaaaatcaatacctttcagttcaattcgattaaccagagtgtccccttcaaatttaacctcggctcgggttttatatgtaccatcatccttaaagctgatggtcctttcttgaacataaccttcaggcattgcagacttgaaaaagtcatgctgtttcatgtggtcgggatatcgagaaaagcattgcacgccgtaggtgagggtcgttacgagtgtaggccatgggacgggcagtttgcccgtcgtacagatgaatttcagagtcagcttaccattcgtggcgtccccttcgccttcgcccctgacggagaatttatgtccatttacatctccatcaagctctaccagaatgggcactactccagtgaagagttcttcacctttactcacgctacctcctcctccgcttcctcctcctccgcttccacctcctccttccagggccttgtactcgaacatgactttcacgagttcgcacagttcctcgctgttccggtcggtcatcagtttctttttcttcagattcttcaggtgcacgatcttctctgattccagggtctggatttcgatcttcttgtcagcgccgatcttgaaggtggccacgaagccgtattctttcagaatgtccacgatggacttcatgatggcgttcttcagcttccggtcgtaggacagcagcttccgcaggttttccagcacttccagcaggctaatctcggcgtgggggatgtagttgaagtgggcaatgtagttccggatgtacaggtcctttttttcctgcttcagtttcttcactttcttgtcggagtagatgctccgcttttccacattgtccttgtacagttctttgtagaagttgatatacttttccacgatctggccgcttttgtacttcacattcttggagttgtcgaaattgaaaatttcctcgatgtagtggttctcgggaaactcgcccttcagccggaatctcaggtcccgctcccagatgctggtgtagcccacgagccggtgcaggatcttcagcagcaggccctgcagcaggttcagctcattgaattccaccttgttcttcaggtgggtgtacttctggatgttgccgatggccttctcatactctttgtagtcctcgtcgttgaacttttcgtccttcttgggtctggcgtacttccggtgcaggttctgctgcatggtgtagttcttttcaatctcattcttcttgttgctgtactctttcagttctttcaggctgatcttatacttggccttatcggcgatcttttccagcagattcagcatgccgtatttcttgatattgtagaaggcccggtgcttgatgatgttctcgccgtcgaaatagatcttgttggtgtcgaactttttcagctctttccggtccttgattttgttttcgttgaagtccaggaacttgccgatctcgttggcttccagctcgaagtcctcggtcactctgttgttgtccaggttcagcaggttgatcagttccaactcgtcgctgaaggtttcttctttgttggcggactggtacttttccaggctgcccttcaggttggtcagctctttgtggttcagcagcttcaggatcaggtaaaacatgttcagattctcggtgtacttcagaatcttccccagcttgatctcgcgcacgaactcattgatctcgtgagggatttctttgttccgattgtgcttctcatagttcttcaggatcttgtcgtacttctctttgttatcctttttgatcttgatcttggagaagatgtcgttgttgtcattgttgttgttgctctcgatatacttcagattgttcttgttcaggtagtcgatgaagcccttcaggaaaatctgctgaataaagtcgatgtaggtattcttttcctctttgtcctggttgttgatcatctctctgctctggatgatggccaggtattccacgggcacggttttctcgatgttctcgaacttctgatacttgtagtggccggttttctggttccgctgcttgttaatcttgatcacttcattggtgatcttaaagaacaccttggagtttttcacgaacttgttcaggaactcgccgtagtagatattcttcagcaggtagatctgggcgtccttctcttctttgtccttgggcacgctccaaaaaaacttcagggtattccgcaggtcctcaatcttgttgtacagcttggtgaagctgggcacgaaggggatgtttttgttcacgaagttgaacttggtattcttcaggtacttgatgatcacatccttctcgtagtagttgaacacgttggcgctgttcagctgcttgaagattttcagcttcagcttcttttcgttgatttcgttctgaaacatcttcttggagatctcgctgggggcgatattcttgaaggcgaagatgtccttgccttccagttccaggttgaagtgcacgatgccgtgtctgatgctgctgatggcctcgtcgatgttggcgaagaagtcctcgatctcgttcttgttgtccatgttgaagtcgtagctgtagaacatcttcagattttctttcacttcgttctgcttgttctcattgtagatcttgtccacctcgccggacacgtatttctcttcgcccttgttgttcttcacggtcttgccccgcatccggccggtgataccgttctcgttctcggtttccaggatgttcctcaggctgaagtaggccacgctggacacgccgatgatgtttctcaggaaggcctcgttctgccggttccgggcgataaagtcggaggtggcgatctcgcccacttgcagatagtagttgtacttgccgcagttccgcacgtaggtgtccagcttgttcagcagtttgttttcgatcagctttttcagattctggtactcgaagatccgcttgatcttatcgttgctgatgttgctcagccgcttgtacacgtagtttttcagcagctgggacatctcgatttccacgaagtggcagaaggcgtacttaatattcttgtcgttcagttcctctttgtccaggtagtacttgtagaacacctggcttttcttcagctcagacatgtcggggatcttctcaatcagctctttgatgttgttcacgttctggatctcttcgtagataatcttggcgaagttctctttgtcgttcttccggccgatgatcttgtgatagtactcgcggatcttgtacttctcgtgcttcttgctgttctcgatcaggaaaaacagtttctcgatatcctctttcttatacagcttgtcgaaggcttcctgcacgttgttgatgtagtcgttgcgcttggcgctctctctgtagtagtcgtagatgatgttccgcttgctcttgccgcccactttttccacgttgttctcgttgatcttctggtagttggccttgttctcttcgaagctgtacttcaggctgttgatcttgttcagcttggcttccacgtccttccgaaagatttccagttcctcagagttcacgtcctcgttcagcaggatcttcttcagcacggagaagctgttcttgtttttcaggtcgtactcgctgatgtcctcttcgctatagttcttgtcctgcacggcgttcttttctttccggttcttcagatacagcacgctgtccttcaggtgcagcaccttgttgctaaagaacttcttcaggttctctcttctgatccggttctcttcctcggaggcgttgtcggggttcttgatgtagatgtccagccggatgctcagcagctcgctcagtctctcgctggtccggttttcctcgctggtggacttcacgagcttgccctcttcgatgtacttcttgtggctgatgccgtcgaccttggtcactttcatggatcgtgctttgtgatctgccgggtttccaccagctgtctcttgatgaagccggccttatccagttcgctcaggccgcctctctcggccttggtcagattgtcgaactttctctgggtaatcagcttggcgttcagcagctgccgccagtagttcttcatcttcttcacgacctcttcggagggcacgttgtcgctcttgccccggttcttgtcgcttctggtcagcaccttgttgtcgatggagtcgtccttcagaaagctctgaggcacgatatggtccacatcgtagtcggacagccggttgatgtccagttcctggtccacgtacatatcccgcccattctgcaggtagtacaggtacagcttctcgttctgcagctgggtgttttccacggggtgttctttcaggatctggctgcccagctctttgatgccctcttcgatccgcttcattctctcgcggctgttcttctgtcccttctgggtggtctggttctctctggccatttcgatcacgatgttctcgggcttgtgccggcccatcactttcacgagctcgtccaccaccttcactgtctgcaggatgcccttcttaatggcggggctgccggccagattggcaatgtgctcgtgcaggctatcgccctggccggacacctgggctttctggatgtcctctttaaaggtcaggctgtcgtcgtggatcagctgcatgaagtttctgttggcgaagccgtcggacttcaggaaatccaggattgtcttgccggactgcttgtcccggatgccgttgatcagcttccggctcagcctgccccagccggtgtatctccgccgcttcagctgcttcatcactttgtcgtcgaacaggtgggcataggttttcagccgttcctcgatcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 1756 - DNA, 12934 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacgcattactaagctggcgcgtgaagctgtagaagtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1757 - DNA, 12994 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacgcattactaagctggcgcgtgaagctgtagaagtgaactgccgagtaggtagctgataactgggaggattcataaagcattgtttgttggctgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1758 - DNA, 14098 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggacacaagctttgacagctagctcagtcctaggtataatactagcgtcgacctttaataaggagatataccatgggtgaactgccgagtaggtagctgataacgcacgacctgccggaattcagcctgactgaaagtgaactgccgagtaggtagctgataactggcccagttggtcgagcatatcaacagaaccgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1759 - DNA, 14028 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggacacaagctttgacagctagctcagtcctaggtataatactagcgtcgacgtggagatataccatgggtgaactgccgagtaggtagctgataacggaagatactgttcgataaacgaacacacatggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1760 - DNA, 14028 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggacacaagctttgacagctagctcagtcctaggtataatactagcgtcgacgtggagatataccatgggtgaactgccgagtaggtagctgataaccattcaccgttgcaccacagatgaaaagctgagtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1761 - DNA, 14035 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggacacaagctttgacagctagctcagtcctaggtataatactagcgtcgacaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctggaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacgagacctctgtcttgtcagctagggtggtctcgtgaactgccgagtaggtagctgataacggatccgaattcgctgctgccaccgctgagcaataactagcataaccccttggggcctctaaacgggtcttgaggggttttttgctgaaacctcaggcatgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1762 - DNA, 14035 bp, Artificial Sequence
  Synthetic
ccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgtgaccttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggacacaagctttgacagctagctcagtcctaggtataatactagcgtcgacaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctggaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacagtgcatcctcggccacgaattctgcggccacgtgaactgccgagtaggtagctgataacggatccgaattcgctgctgccaccgctgagcaataactagcataaccccttggggcctctaaacgggtcttgaggggttttttgctgaaacctcaggcatgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattg

SEQ ID NO: 1763 - DNA, 3665 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttggaacaaccataaaatgataattacacccataaattgataattatcacacccataaattgatattgcctcttcatggtctaaacttcagtaagtttacgacattttcctcgaggtaatacgactcactatagggtgactcggaattgtgagcggataacaattcctgactccatgggtgaactgccgagtaggtagctgataacagtacagcgcggctgaaatcatcattaaagcggtgaactgccgagtaggtagctgataacggatccagtcagactgtcactagcataaccccttggggcctctaaacgggtcttgaggggttttttgctagctcgaacatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 1764 - DNA, 21 bp, Artificial Sequence
  Synthetic
ctgaacttcagcctccagtac

SEQ ID NO: 1765 - DNA, 20 bp, Artificial Sequence
  Synthetic
ccatgtcggcagaatgctta

SEQ ID NO: 1766 - DNA, 10375 bp, Artificial Sequence
  Synthetic
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgctaatacgactcactatagggtactaatagcgccgcagttcatgctctttaagagtctctgtactgtggaaaatctgggttagtttgacggttggaaaaccgttttgctttctgaccctggtagctgcccgcttctcatgctctgacttttcacgttatgtggaaaaagtaacgtaatttcgttagttaagacttaccgtaaaaagtcagttctgatgctgctgtcgcaagacaggataggtgcgctcccagcaaaaggagtatgtcttgaaaaagactagccgttctagtaacggtgcggattaccgcagtggtggctactgaatcacccccttcgtcgggggaaccctccaaaaggtgggttgaaagttcgacgttcagacgtagtgtgagtaccctagcataaccccttggggcctctaaacgggtcttgaggggttttttggtcgaacagaaagtaatcgtattgtacacggccgcataatcgaaattaatacgactcactataggggaattgtgagcggataacaattccccatcttagtatattagttaagtataagaaggagatatacatatgagcacaatcacgattcaatgccgcctagttgcagaagaagcgaccctgcgctacttttgggaacttatggctgagaagaatacgccactcattaatgaattgttggagcagttaggacaacatccagattttgatacttgggtacaagcaggcaagatgcctgaaaagacagttgagaacttgtgcaagtccctagaagatcgagaaccttttgcaaatcagcccggtcgttttcgtacttcggcagttgctctggtaaagtacatttacaaatcctggtttgcgttacaaaaacgtcgggcggacagactagaaggtaaagagcgctggttaaagatgctcaaaagtgatgtggaactggaacgagaaagcaactgtagtttggatattattcgagctaaagctggggaaattcttgctaaagttactgaggggtgcgctccgagcaatcaaacatcctctaagagaaaaaagaagaaaactaaaaaaagccaagcgacaaaagatctccctacgcttttcgagattatattaaaggcttacgaacaagctgaagaaagcctgacacgagctgcccttgcttatctccttaaaaatgactgtgaagtcagtgaagttgatgaagattcagagaaatttaaaaagcgtcggcgtaaaaaggaaatagaaattgaacgtttaagaaatcaactgaaaagtcggatacctaaaggtcgcgatttaaccggagataagtggttgaaaacgctagaagaagccacccgaaatgttcctgaaaatgaggatgaggcaaaggcttggcaagcccaactcttgagagaagctagttctgttccttttcctgtagcttatgaaactagtgaagatatgacttggtttaccaacgagcaaggtcgaatctttgtttactttaatggttcagccaaacataaatttcaagtttattgcgatcgccgtcaacttcattggtttcaacgttttgtagaggactttcaaatcaagaaaaatggtgataaaaaaggtagcgaaaaggagtaccctgctgggttattgacgctttgttccactcgtctgagatggaaagaaagcgcggaaaaaggagatccttggaatgttcatcgcctaattctttcttgcactatcgatacacgcttatggacacttgaaggaacggaacaggtgcgagctgaaaagatcgctcaggttgaaaaaactattagcaagcgggagcaagaagttaatctgagtaagactcaacttgagcgtttacaagccaagcacagtgagagggagagattgaacaacatttttcccaaccgccctagcaagcccagttaccggggtaaatctcatattgcgatcggtgtaagtttcagtttggaaaacccagccactgttgccgtcgtagatgttgcaaccaagaaagtccttacttaccgcagtttcaaacaattactcggagataactacaaccttgcaaaccggctgcggcaacaaaagcaacgtctttctcacgaacgtcacaaagctcagaaacaaggcgcaccaaattcatttggagactcagagttagggcagtatgtagacagattgcttgcaaaatcgattgtcgcgatcgcaaaaacttatcaagctagtagtattgtcttgcctaaacttcgctatatgagggaaatcatacataatgaagttcaagctaaagccgaaaaaaagattccaggatataaagaaggtcaaaaacaatatgccaaacagtatcggataagcgttcatcaatggagttataatagattatcacagattcttgaaagccaagctacaaaagctggaatttctattgaacgtggatcgcaagtaatccaaggtagctcccaagaacaagcacgagatttagctttatttgcctataacgaacgccaacttagtctgggttagtaacctttaataaggagatataccatgggcttagacgaagaatttgagttcactgaggaattgacgcaagctccagatgttattgtgcttgacaagagtcattttgtggtagacccatcccaaattattctgcaaacatcggataagcataaactgagatttaatcttatcaagtggttcgctgaatcccccaacattactattaaatctcagagaaaacaggcagtcgtagatacccttggtgtttctactcggcaggtggagcgtctcctcaagcaatatcataatggtgagttatcagagacagcgggagtacaacgctcagataaggggaaacttcgcatcagccaatactgggaagattatattaaaacaacttatgaaaaaagtctgaaagataaacatccaatgttgccagcagctgtcgtgcgggaagtgaagcgacacgcgatcgttgacctcggactgaaaccaggagattatccccatccagccaccatctatagaaatttagctcctttaatcgagcaacacacgcggaagaaaaaagttagaaatccgggttcgggatcttggctgaccgttgtcacgcgagatggtcagctactgaaggctgactttagtaaccaaattatccaatgcgaccataccgagctggatattcatatagttgatagtcatggcagtttattgtctgaccgtccttggctaactactgttgtcgatacttattcaagttgcattcttggttttcatttatggatcaaacaaccaggttctacggaggtagctcttgccttgagacacgccattctacccaaaaattatccagaggactacaaacttggcaaagtttgggaaatatatggacctccttttcagtatttttttactgatggtggaaaagattttaattcaaagcatctaaaagccattggtaagaaattaggatttcagtgcgaactacgcaatcgcccgccccaaggtggaattgtagaacgtctttttaaaaccattaatactcaagttcttaaagagcttcccggttacacgggggcaaacgttcaagaacgcccgaaaaatgcagagaaagaagcctgtttaacaatacaggatttggataaaattctagccagcttcttttgtgatatttataaccacgaaccctatcccaaggagcctcgcaacacgagatttgaacgctggtttaaaggtatggggggaaaattacccgaacctttggacgagcgagaattggatatttgtttgatgaaagaagcacaacgagttgttcaagctcatggtagcatacagtttgaaaacctaatttatcgaggagaagctctgaaggcatatagaggtgaatacgtcaccctaagatacgatcccgaccatgtcctgactttatatgtctatagttgcgaagctgatgataatgcagaagagttcttgggctatgctcacgctataaacatggatactcatgacttgagtatagaagaattgaaaactctcaataaagaacgaagtaaagctcgtagcgatcattacaactatgatgctttattagcattgggtaaacgcaaagaacttgtagaagaaagaaaacaagacaagaaagcaaaaaggcaatcagagcaaaaacgtctccgcactgcttccaagaaaaactcaaatgttattgaactacgcaaaagtagagcttcgagttcttcaagtaaagatgaccgacaggaaattttaccagagagagtttctagggacgaactaaagccggagaaaacagaactgaaatatgaggaaaatctgttagcacagaccgatactcaaaaacaggagagacataagttagttgtctctgaccgtaaaaaaaatttaaagaacatttggtgataaaggaggtaaataatggccatatctcaactggcaacccaaccatttgtcgaagtcttacctccagagttagatagcaaagctcaaattgctaaaactattgatattgaggagcttttcagaattaattttatcacaaccgatcggtcatcagaatgtttcagatggttagatgagctgcgtatcctgaaacaatgcggtcggatcattggaccaagaaatgtaggcaaaagccgagcagtgcttcactatcgtaatgaggataaaaaacgagtttcttatgtaaaggcttggtcggcatcgagttctaaacgtctattttcacaaatcttaaaggatattaaccatgctgcatcaacaggtaaacgacaggatttacgtccaagattagctggtagtcttgaactatttggattagaattggtcattgttgataatgctgaaaatcttcaaaaagaggcgctcttagatttaaagcaactttttgaagaatgccatgttcctattgtcttagttggaggtaaggagttagatgatattttagaagattttgatttgttgactaactttccaacgttatatgagtttgaacgattggaacatgatgattttataaaaacattaaagacaatcgaattggatattttatctcttccagaagcgtctaagttaagtgagggtaacatatttgcaattttagctgagagtacaggtgggaaaataggaattttagtcaagatactaactaaagcagttttacattctcttaaaaagggatttggtaaagttgatgaaagcattttagaaaaaatcgcaagtcgttatggaacaaaatacgttcccattgaaaacaaaaatagaaacgattaatagaggaggatataaatgattgaagatgatgaaattcgtctaaggttgggctatgttgaaccacacccaggtgaaagcatcagtcattatttgggacggcttcgtcgatttaaggctaacagccttccttcaggatatgctctaggaaaaattgcgggtcttgggtctgttctgactcgatgggaaaagttgtacttcaacccatttcccactcaacaagaactagaggcattagcacaagtgattcaagtggaggttgagaaattaagagagatgctacccactaaaggtgtcacaatgatgcctcgacccattcgattatgtgcggcttgctatgcagagtcaccttatcaccggatcgagtggcagtttaaggacaaaatgaagtgcgatcgccatcagttgcgcttattaacaaaatgcacaaactgtcagacaccattccccattcctgctgattgggaaaaaggagaatgctcgcattgttttttgtcttttgctaagatggtgaagtgtcaaaagcgtcgttagtaacctaggctgctgccaccgctgagcaataactagcataaccccttggggcctctaaacgggtcttgaggggttttttgctgaaacctcaggcatttgagaagcacacggtcacactgcttccggtagtcaataaagcctgcagcaaagactacctacttaaatgaaccgcaaatgtacattcgcaaattaaatgtcgtaattcgcaaatttgtgtcgtttttcgcaaattaatgtcgtttagaatagtttgtctcatcaattcaattataggaacttttcgcaaattaatgtcgtcctgtttctccatttagtgtcgattaacaaattaatgtcgctgttaacgaattaatgtcgtcgaattagttccaactaacgttaacaaattaatgtcgtctaacataatgtcttgctaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagaaaaaccactgattaacactttaggtactaaagtaccactaatgtggcaaaaatgcgacatctaatttgcgaaacaggcaaatcttaataaacgacatttaatttgcgaaaataggatttgcgacatctaatttgcgaaacaggcaaattactcagttttatggataaatagcttgtaagtcctacgcaataaagatctcagctattagaagtaattgcgacactaatttgcgaattgcgacatataatttgcgaatgtacaccaagctttaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 1767 - DNA, 690 bp, Vibrio cholerae strain 4874
atgtctgctctaccttctccttctactaccaccctgattgcacttgaaagtgcatttgttactcctgctcgaaacttaactaagtcgcgtgggaaaaacatacaccgttacgtcagtgctaagatgggaaaaagagttacagtagaatcttttttagaatgtgttgcttgttatcattttgattttgagcccagcatcgttcgcttttgttctcagccgataagattttcatacggtctaaatggtaagacccatacttatgttccagactttctagttcaatttgataccggtgaatttaagttgtacgaagtaaagtccgatatggaaagctcaaaagaggaatttcaatgtgaatgggaagcaaaagttcaaggtgcgtttgagttaggtttggagctagagctggttacagaggaagaaatactggatgaggtcatatttagcaaccttaagcttttgcatcgatatgcttcaagagataacttgaatcactttcatcaaactctccttgccacctttaaattgaatggtacccaaaccgcaaagagtttaggacaccatcttggcctaaatggaagaaaaatattaccgttcctgtgtgatttgctctcacgaaacttactccaaacaagcttagagacgcctctgtcactcgagtctgaatttgaattgggttgttatgcctaa

SEQ ID NO: 1768 - DNA, 1812 bp, Vibrio cholerae strain 4874
atgcctaataaatcattttcgagttttcatcggaagtcagcatttcagcaagaaaaacttgagccgaatgatagggttgttgatgacaacgatgtcgacgaagcaacatatcaagatatatccgcatttcctgacaatatagccactcagattacttttcgtctaagtatccttcgttatttagcaagtaagtgcgaacgaatcattccaaagactatcgaaccgcatcgagtcggactacaacgtttacacgacaggaagattccaagtgcgatatcaatataccggtggtggttagttttcagagcgtctggttgtaacccagttagcttagctcccaagaataaaaataagggtaacagtaaagccaaagtaccaacattcgttgatgctttgatggaacaagctgtagacagagttatctctgggagaaaagtgcgtataagaagtgcctacaggcgcgtgcgaaggaaattacgtcagcataatctgaacaatggaacgaagtacaaatacccaacttatgaatctcttcggaaacgggttaaaaagaagactcctttcgaattactggctgcgaagaagggcgagcgagtcgcgaaaagagagttccgtcggatgggaaaaaagatattgacttcttacgtccttgaaagggttgaaatagatcatacggtagtggatctctttgctgtacatgaagaacatcgcgtgccattgggccgaccttggcttactcaattagttgattgttacagcaaagcagttattggtttttacctagggtttgaaccaccgagctacgtatctgtgtcacttgctcttaaaaatgcaatactgcggaaagatgaccttttgagctcgttcgactcagtagaaaatgaatggctatgttacggtatccctgacttactcgtaactgataatggtaaagagtttttgtctaaagcttttgataaagcatgtgaatcactgttgatcaatgtacatcaaaacagagtcgaaacgcccgacgataaaccgcatgttgaacgcagctacggaactatcaatacttctctgctagacgatttaccagggaaagcttttagccaataccttcagagagaaggttatgattcagtgggcgaagctactcttacattggatgaaattaaagaaatttacttaatttggttagtcgatatttatcatccaaaatctaaccagagaggtactaattgtccgaatgtagcatggaaaaggggatgtcaagaatgggagcctgaagagtttaatggatctaaagatgagttggactttaaattcgctattgttgatcaaaaacaactaaccaaagctggtgtaactgtttataaagaactgacatacagtagtgaacgtttagctgagtataggggtaagaaaggaaatcataaagttcagttcaaatataatccggagtgtatggcggtcatttgggtgttagatgaagacctgaacgagtacttcacggttcacgcgatagactacgaatatgcaagtagagtgtctctctggcaacataaatacaatatgaagtatcaagcagagttaaattcagcagaatatgacgaagacaaggaaattgatgcagagataaaaattgaagaaatcgctgaccgttcaattgttaagactaagaaaatcagagcccggaggcgtggagctagacatcaagagaatagcgcaagagcaaaatccatcagcgatgccaagcctgtcccatcccagaaacatgaagacgaaattgtaattgttgataatgaagattgggatattgattatgtttaa

SEQ ID NO: 1769 - DNA, 990 bp, Vibrio cholerae strain 4874
atgaatgaaactcgagaagcacgcatctcaaaagctaaaagagcatttgtatccacgccgagtgttacgaaaatcttatgctacatggatagatgtagagatttatcagacttcgattctgagcctacttgcatgatggtctatggtgcttcgggcgtcggtaaaacgaccattatcaaaaaatatttaaatcaaaacaggcgagattctgaagttgggggcgatataattccagtcttgcatatagagctgccggacaatgcgaaaccggtagatgctgcgagggagttgctggttgaaatgggggatccgctagcgctttatgaaacagatttagccagattgacgaaaaaactgattgatttaatcccggtggttggtgtgaagttgattattatcgatgagttccagcatttagtagaagaaaggtcaaatcgggttctcacgcaagtaggtaactggctaaaaatgatactcaacaaaacgaaatgtccaatcgttcttttcggcatgccatattcaaaggttgtactacaagctaactcgcaacttcatggacgattttccattcagttcgaactgagacccttcagttaccagggaggtgaaggcgtattcaaaacttttttggagtacctcgataaagctttaccttttgaaaagcaggctggcttagctaacgaaagtttgcagaaaaaattgtatgcattctctcaaggaaacatgcgctcattgagaaacctcatttatcaagcatctattgaagcaattgataatcagcatgcgacgatcaccgaagaagattttgtttttgcatcgaagttgacctcgggtgataaacctattacctggaaaaatccttttgatgagggtgttaaagtgacggaagatatgttgcggccgccaccaaaggatattgggtgggaggattattatcataacgttaaacccaaaaaccaaagacgcaagggtagtaatatgtttgaataa

SEQ ID NO: 1770 - DNA, 1194 bp, Vibrio cholerae strain 4874
atgaagacgatgttactgcaacgaccaaagccattcgaagatgaaagtcttgagagctatttaatccgaatagcaaacagaaatggttatcaagatgttgatcgttttttgtctgcacttaaacactatttgtgtgatggggattctgaaaaattttcctcattccccactgatatccgtcgaataaacccatattcctcaaaacatagttcagctgctagaagtcatgctcttcataagataggtcaattaacatttacggaatccgttgatttactgaagttagccatcaatcgttcgccacttaaatattccccctcagtaacagcagttatccgtggtcacgaggttttccctcgctctttactaaggaccaatatcataccggtatgccctgtttgccttcaggaaaatggttacgccagctatttatggcattttgaaggttatgactactgccatattcacgatctcgctctaacgtataactgtcaatgtggcaaaccttgcgactaccgagtaagcggtttacaactagtttgcagctcatgtggaacgacactaactcatttattagaaaagccaactgataggtcatccgatatttctcactggctagcaggcgaaaccataaaatggttaccagcagttcccgtaagttatcgttgggggctagttcattggtggatgaataataaaaaatcaaaagaactggaaacagagagcttcacgattttttggaaaaattggcccaattcctttcataacctaattcaagaaactcttagttacaatcagacctactcactggtagcacccacccaatggagacttaaagacttactaggggaaatactttttagctcaataaacttgccaggtcgaaatctacaatacaacttgatactgagagagcttttccattatctagaaaatcatttgtgggaaaacaatggattaattgcaaacctaagactaagcgcctttgaggtttctctaattttaggctgcagcactgaagaagtagcgtctatgtcagaacaaggattgttgattcccatacaaaaccggaaacgttatgaacctatgagtctaacaaactgcatttttcattttggtgacgtcttctgcatttggttagctgaatttcagacagatgaattcaaccgttcattttatacctcacgatggtga

SEQ ID NO: 1771 - DNA, 1971 bp, Vibrio cholerae strain 4874
atgaattcaaccgttcattttatacctcacgatggtgataaaatgactttagatgagctattggcaactactaaatatgaagaattagtatcttcaactaaacggtcatttcgtccattatccccactgattgatatcactaacaatccgatgacggcattgactatcttagtcaatctgacagagaaagggatatccaacaaaaatcttcttgataaagagcgttgtaaagaaaaactgagggatgacaaatggtgggctgcagtcttaaaaccagcccaataccgtcacagccataatgttaaatttcctgatattcgttctacaggcacaattcgaacagtagcacctgataaccttccggcttatttcatcacgtcgagcaaactgcctaacgtaggatggacttactcaaaggattcctctgatatcaatcgctgtctgttttttacctctgaatttttatgggctggacaaccatgctgtttagccagagcgttaacggatagtgaacacccactttggagtacactcaaaaaacttgggtgttatgagaaaaataaaaaactggcagcaaagctgctttctcaaatccccggcgaactcattgatgttgatttaaccggtaattacctcagccaagtttcttttccggatggtcgggatagttatctgtctttctctcccgtcgcatctcaagctatgcaaagttgtgtttatcaatcactagaacagcattatcgacaaacggcccttatgcgatttgaccgagcaaccaatatggggctactttcagccagttgtggtggccgatttcgcctgattgaaacgaaaccctacatcaaagataaacgacaccactatatttcagaactaccaaactggctcaccaaagaagctattcaatcagtagagcagtttctaagatcagaacaatggctagttacccataatgataagccacgtaatatggcgatagtaaaatcttccattcgttctatggtgaatcgctggttaagctctcgtacaaatacagaagccctgtctccggctgagttagcggaacaacttaataacgacatagcttccaaacgtattataaaaagatacgcttaccaacctaagttgactcggttattcatacaacttatagaaaatactggagaagataacgcttacaaagaagatagaaaaccgacaacgaatagtcagtaccttttgatccctgaactcagaatctctggaggttctgccataagttcatcggtcagtgtaggactattttcaatgatgtcgctttatggatttatccatgcgttcgaacggaatatgcagcttgtactgacgagttttaccattgatagttttgccatatgcgtccatgactatcacttggaaaaacgagggttaaccaaagagccgattaaaaaggcaaaagtacgcaaagatgaacaagaaaaaatagcacctcctgctatctatgatgattatcaattcgatagttgtatcagtctaattatcaaaacatcagaatcaaaaactatacccgctgaaaaaatggtggcattacttccaaaacgctttgcgaggggcgcaatccgattgtccattgatggcattcaagaaataggagcgtttcccaagccattacccgcaatacaggcaataaaaaatccacttggtagttggctgtcgtttgaacctgacttgtctttaatatcaactgattcaatagtcgatatagctaccaatcacaataatttatggttgacagtgatgggataccagtatttagaaccacccacaacaaaacctagttcgctacgagactaccctcatgcccttgtcgaaaatatcttgggatttgttaagcctagaaccgtaacaaaatcgaccaatttagatgatctattttggcgctatcaaatccaaccatttggcgtctgcttactaccaaggagtatcaagtga

SEQ ID NO: 1772 - DNA, 1038 bp, Vibrio cholerae strain 4874
gtgaagcttcctatccatctagcctatgaacgctcaatttccccttcagatgttgcctttttagtcatttggccagatggatacaaagagccactgccttgttacagtcgcacaatccttggccttaacgaaggttcacacgttggctatgatggttctggcgccgtacgaaataacttaaaaatgaatacgctggtcgacggcaatattcatgagttggactattgttctgtgccatatggagcgaaatcaatagagtgttgtttctccgtttccttttcttctgaattactcaagccttataaatgttcagatgcaggcgtaaaaaagacacttagagaatttgttagtctatataaccaacacgtagggttagaagaactgataatcaagtacctgactaatattgcactaggcacctggctttggcacaacaccaaacgaagctattgtgtctccatagaaattcggccgtggccttgggaaggtgagacaatcatcattgatgatatacgcaaatatctcaagggcgatagagcgaccaacgacttactcaactggaacaagctgattgaacaagtaaaagaagctttcacagaccctatgggcttatgcatattggaggtaaaagctaacttaatcaaaccctcgatggcgcagctttatcctagccaaatgttcaaagaagcagccaagaaagagaacaaccgtctctatcaatcaaccatcattgatggtatcaaatcacccattatgggctgttacaaaactggggcggctatcgctactatagatacttggtatccggacgccgaggaaccaattcgggttggtcactacggtgtagatcgagaaaacagtactgcatatcgacatcccgatacaggaaaggacttctttagtattttaaagcgaatagacgaattggttgatcgactaaaagatgccaaagagttaagtcaagacgaactcaaagatatgcatttccttatggctaatctaatcaaaggtgggctatttcaggaaaaaggggaatga

SEQ ID NO: 1773 - DNA, 594 bp, Vibrio cholerae strain 4874
atgatactttactatcgaacagttacctttttgccaaaaataaaaaataacgaagcattagtgggacactgtctgaaggttcttcatggtgtatgtactaagtacacaatcaacactatcggagtgtcttttcctgagtggggagaagagaccatcggtgacaaaattagttttatctcacccaaccagctcgaactggactttttacttcaacaaacctatttttctgaaatgacagcgcttggatacctaaacatatcgcagtcaaaatcggttcctgaacaatacaatttggctgttttccggcgcaatcaaaaaatcgaccaagcgacaccgaatggacaaagaatcagagccgaacgtttggctaaacgagctatgaatagaggcgattcaccgattcggtttaccccagaagacctcgtattcgaacattatcattctataccgataacaagtacccgtagtggcaaatcattcaggctaaatttgcaatatcaacgactagatacagttccagatggacaatgggcattttcaagttatgggttagcaaatcaagagcttgaaagtagtcctgttcccgtaatttga

SEQ ID NO: 1774 - DNA, 28 bp, Vibrio cholerae strain 4874
gtgaactgccgagtaggtagctgataac

SEQ ID NO: 1775 - DNA, 510 bp, Vibrio cholerae strain 4874
  misc_feature (251)..(260): n is a, c, g, or t
tgttgatgcaaccataaagtgatatttaataattatttataatcagcaacttaaccacaaaacaaccatatattgatatctcacaaaacaaccataagttgatatttttgtgaatcgagtatttcagcaaaactactgcagtaagaaagttactttcagcaactggcaaaactcatcaaaagaaccacttcaaaattagaaaacatataatcattacagttccgataaccttgcatcagtcacggacactnnnnnnnnnncttagcactgacgtaacggtgtatgtttttcccacgcgacttagttaagtttcgagcaggagtaacaaatgcactttcaagtgcaatcagggtggtagtagaaggagaaggtagagcagacataatattgcctcttcacgattttgtcgtaaacttacataagtctagactatgaagaggcaatatcaagttatggttgcaccaaatatcaatatatggttgtaaatatcactttatggttgtttcaaca

SEQ ID NO: 1776 - DNA, 687 bp, Photobacterium iliopiscarium strain NCIMB 13355
atgcaaccttctcctgcaacgacatatcaaacagactctcctcttgagttcgcatttactcaaccagctagaaagttaacaaaatctcgtgggaaaaatatacatcgttacgttagcattaaaatgaatactatcatttcagttgaatcgacattggaattcgatgcctgttttcattttgattttaataaaaatatctctcgattttgctcacaacctattagatatagttatgtcattgatggaattattcgtacttatgttcctgactttttatgcgaattttattgtggtgagatggttctatacgaagttaaggcaccaaatgctgttaattcaaaacgttttactaaagagtttgaggcaaaaagacagtatgcgagaaaactttttgatgtagatcttgaattgattgaagaacacgatattagacatattcctcttcttaaaaacttaaaacgtatgcacagatatgcatctcattctgaattaacttatgagcaaacaactattcttaagtatttgaataaacatggctcaacaaagctagaaacaataattgatcattttagtaatagtaaaaatataattccgatgatttatgatttattgtctaagtacttgataaatactgaccttagagttcttctgaataaccaaactgaattaaagacaacttatgtctag

SEQ ID NO: 1777 - DNA, 1812 bp, Photobacterium iliopiscarium strain NCIMB 13355
atgtctagaacatcattttctagttttcatggaaccccaacatctgatagcgaaaatgcttccagtaagctcacatttatcgaaaatgatgatttgcaagatttaacatcatttagcaaaaaagctcaaaatgaagctaaactcagattaagtatacttcgaaatatattgaataaaagttcagaaataaacttagttttaattgaacgcttacgggctgatcttcaacaacaaggagagcgatcaataccaagtgcaattactatctatcgatggtggttaacttataaaaaatcaaactttagtattttatctttagtaccaaagactaagcaaaagggaaatagaaacacgaaggtacctaaaacaatatcagtctatattgatcaagctgttgaacaagtaatttctgccaataaaatcaatgttagtacagcttttagacgagtcagaagaaaagtaagacaatataatcttacccataaaacaaagcatacctacccttcatatgaagccataagaaagcgcgtaaaaaaaatcaccccctatgaaaaattagctgcaagcaaaggagatcgaatagcaaaacgagaattccgtcgtatggggaaaaaaatccaaactgagtacttactagaacgagtagaagttgatcatacatggttagatttatttgctgttcatgaagaacatcgagtacctataggtcgtccttatttaactcaactagtagattgtcatagcaaatcagtaattggtttctaccttggctttgaaccaccaagttacatgtctgttgctttagcattaaaaaatgcaatcaaacgcaaagataatctattacaaaactatccatcaattcaaaatgagtggttatgttatggaatccctgacctacttgttacggataatggtaaagagtttttgtctaaagactttactcttgcttgtgacagtttacttataaacattcatcaaaacagagtagaaacacctgataataaaccgcatacagaacggcagtatggaaccactaacactgaattacttaatgatcttcctggtaaaacatttagtaattacttacaaagagagggctacaattccagcgacgaagcctcattaacattaagtgaaatcaaacaaatataccttacatggcttgttgatatttttcatcctagaccaaattcaagagggacaaattgcccaaatagagtatggaaacacgctgaaaaaaattggcctccgaatgaatttcttggtaccgacgaagaacttgatttctattttactaagttagataaacgaatgttaagaaaagaagggattggactagcaacagagcttttttatagcagtgaacgattagcagaataccgaggtaagaaaggtaatcataaagttgcgataaaatataaccgcgaaaatatgggcttcatatgggttcttgatgaagatacagaatcttatttcaaagtccctgctattgattatgaatatgcgagtacagtaactttatggatgcataaaaaaaacctaaaaataaaacaagaactcaatattaccgaacataacttagactctgaaattgatgctgaattaagaattgatgaaattgttgatcaatctattcaaaagaaaaaaacaacaataacaaataaacgtcgtgctgctcgatatcaagaaaacgaacaaatggctgctaatgctcgacaacctaaagaaaaaaaatctgctaataatcaaaagacatctactaaaaatattgaaaaagaagatagtagtggatgggatattgattatgtatag

SEQ ID NO: 1778 - DNA, 987 bp, Photobacterium iliopiscarium strain NCIMB 13355
atggatgacaacattacaagaattaccaaagcaaaaaaagcgtttgtatctacgcctgatgtagctgctatcataaacaatatagatcgatgcagaaggctctctaaatttggggcagaaccatcgtgtatgatggtatatggcgcatctggcgttggaaaaacctcaattataagaaaatacctaaaagcgaatgataaagactcaacagcacgacaagatattgtccctgttgtttatatcgaattaccagagaatgcaaaacctgtagatgccgctcgtgaactcctgctctaccttgaagatcccttagctctttatgaatcagacttagctattttaacaaaacgaatagtagatttagtaccaacaatgaaaatagagcttattatcattgatgaatttcaacacttagtagaaaaatcttcaaatagaatactctcaagagttggtgactggttaaagatgttaataaataagacaaaatgtcctgtcattctttttggtatgccctattcaaaagtagtcttggcagcaaacagtcagctgagaagccgcttttcgatacagtttgaattaaaaccatttagttatatcaataattatggcatttatgctggttttctcagacgtttagatgaagccttaccttttgatcaattatcaaaccttgcatcagaacctatagcaaaaaaaatctatgcattttcgcaaggaaatatgcgttcacttcgaaatttagtctttcatgctgcggtaaatgcaattgaaaacgacaataactgcatcagtaaaaacgactgggaatttgcctctaatttgacatctggcaataaactctcaacatggaaaaacccttttgctcaaggcgtcaagatcacagatagaatgttgcaagaccaacctaatgacttaggttgggaagattatatgcgcaacaatagaggaaaaagaaaacctttcgatgagagtaagatctttagctaa

SEQ ID NO: 1779 - DNA, 1179 bp, Photobacterium iliopiscarium strain NCIMB 13355
atgtttctacaaagaccagagccatattcagatgaaagtttagaaagttttttcatcagagttgcgaacaaaaatggctatgaagatatccatcggttcctcattgtaacaaaaaagtatttacaagatgaaaaccacgatagatttaaggctttccctactgatattaaaacaatcaatccttactcgtctaaaaacaatcatggttcaagagtagcagcactgcacaaaatagcccttatgacttttaatgagcaacctgagatactgtctttagcaataaataggacatctctaatatattcgccatcaacaaccgctctagtacgtggtagtgaggttattcctcgctcattattacgaaaaaacattattccatgttgcccaagatgtttacatgaggaaggttttggacattatttatggcatttcaacggttataattactgccacaaacataatactccattaatatataagtgcgcatgtggcgcagattatgattatcgaatagcaggcttaaatggattttgcagagaatgtgatacgtaccttaatccaaaccaacaacatccagatagtgccgaaagcaaaacttccgcttggctttcaggcaagactatcgagcaactgcctgacttgccccagagctatcgttggggtctaattcattggtggactcaccttactcaaaaagagtttgatggtgcttcctttattgacttttggcatcgttggcctgaatcctttcatcatttaatacaacaaaaaattgaatttaatttagagcattcaattattcatcatgataatttgaagctaaaagatctactgggagatttgttctttaactgtattcgattacctgaaaggaatttaaagtacaacattgtgcttaatgagttattgagatttatagatgataatttatggggtaacaatggacggcttgcaaatctaaaaatgaatgctgtagaagtctctattttcctcaattgctcgtgcgatcaaattgtattaatggtcgaacaacggtttttaaaacccagccggaaagctaaaccaaataaaccattaagttttactgattacttgtttcacctaggagatgtttattgcctttggttagctgaatttcaaaccgatgagtttaatcgaacatttatcatttcgaggtag

SEQ ID NO: 1780 - DNA, 1911 bp, Photobacterium iliopiscarium strain NCIMB 13355
atgagtacactagctaaaattattaattcatcgtcatcagatataaatgttgaactcaaaagagcttttcgcccactgagtccaaatattgatatcaccgacaacgaagatatcgctctcatcattttaacgaacctagccgcaaaagtagacgcaaaaaaaaatttgaccgatagagaaaactgtaaaaaaaaattaaaagataacaactggtggtcacgttgtattaatacaatgaaatttcgacaaagccacaatgttaaatttcccgagataaaagcaaccggaataattagagctcacccaatgggtgaaatacccaagtacttactatcttcttcaaaattaaaacaaaaaactttggcttatgcgaatgattcaaaggatgtcagtgtcgctaattttttaatcagtgaatttatcttgcacggcaaaatttgttgcttgggcgtcttgcttacagatgagcagcatcctctctgggatcgtttaacaaaactgggctgttatcaaaaaacacgcaagtacgtagcaaaacaacttaaaaaaattccaaattcttgtattgaagtacagctaggtgctaattctgttcgacagatttcattacctgacgggaataactcttacttatctctatcccctgttacctctcaaacaatgcagagttcatgctatcagtctcttcataaacactattggttaagtaaaattacccgttatagcagagcttcaaatatgggtgtacttccgatgacctgcggtggaacattacgcatgttaagtcatactataagctttgaagatgtcaaacattgccaaatatcgcccaactcatcttggttaactaaagattcaatacaagctttctacgactattttgattcttcaaactggatgatgcctcacattcaaaagcaacaaaagttaaaaatactaaaaatcacaatcacagaaatgatatctcgttggttagcattacaaaaaaacacaatacaacataatcagttagagcttgtacataaactaaatttcgatctatcaaatacaaaatccttaagacaatttgcctacgatccaaaaacaactagatttctatttaccttaattgaaaatagatcaaacacacagcaacctaatgagaactttgataatcaatatcttcttttgcctcaaatttctgtttgtggtgcatctgctatgagttcatccatcactattggaataccctctttaaccgcattttatggctttattcatgcatttgagcgaaacatgcaaaaggtcttttcaaacctaaaagtcgattcatttgctatctgcattcatacttttcacttacaaaaaagagggatgactagggaaagtataataaaattgacaagtaatatatcttcccctgcaactcatgatgaatggcattgtgatctgaaatttagtctggctctcaaagtaaataatcttactcacctcaaccaaagcgaaatattgtatgcattgccaaaacgacttgctggaggctacgcaagaataaatatagatgacataaagacgattcaagtatcttctagctttaaggatttggttaaacaaatacccacttttcaaggacaatggctatccttatacaaggcgaaaattgattcctttgaaagcattattcaacaaataaaagcatcgcaaaatataatcccaacttgtgttggatatcattacctagaaaagccgacagaacgcacttttgccctaagagactacaaacatgcgtttgctgagcctatcattggtctcatcaaaccaataactattaaagaagatacaagtttgcatgatttgttttgggaccaaattaacaagccacactacaccacaatagagacaaggaatatgaataatgaagctccctattag

SEQ ID NO: 1781 - DNA, 1050 bp, Photobacterium iliopiscarium strain NCIMB 13355
atgaagctccctattagtcttgcttatgaacgatcaatccatcccagcgatgtttgcttttttaccatttggccagatggaaataaagcccctttatcttttatgagccgaacagtacttggtcaaatggaaaccgcatcactcgcttacgatactaaaggaaaccctaaacaaacggctactcctgaagttcttgcacaaggaaaccctcatcatatggatttctgtagcgttccctttggcgcagagcatattgaatgcgttttttcagtttcattctcttcagagcttcgcaaaccttacaagtgtagcgagcctgaggttaaaaacactttgattgagctggtcaaattatatgagtcaaaaatcggttgggatgaactcgcaggtcggtttctaaccaatatttgtcaaggaaaatggttgtggaaaaacacgaaaaaaacgtaccaactaaatattgaaattaaaccttggccttggaaaaataaccccgtcattttcgaagatattagaacaaattacagtacttataatgactgccaatctgataccaaatggcaagaattaaaacaactcatcatcaatgctttctcctcaaaaaatggcctcgctattttcgagataaaagcacaattaactctaccaacaaatgctgagctttacccaagccaagcatttattgaaaaagataagaaagaaaaaaaacatcaatctagccgtatatttcaacatacatcaatcaatggacaaaaaagccctatcataggctgctataaagcaggagctggcatttttatgattgatgattggtaccctaatgcagaagaacctattcgtatagggagattcggtgtacaccaacaagatgtaacttgctatcgccccccttcaactcatcaagatctcttttctttattggagcagtctgaaaaatatatagctttattaaaaaatagaaaaaaaacacctcaaaaaacaataaatgaactgcactttttaatggctaaccttatcaaaggcgggttgttccagcataaaggagaataa

SEQ ID NO: 1782 - DNA, 600 bp, Photobacterium iliopiscarium strain NCIMB 13355
atggattggtactataaaacgattcgatttattccgactaattgcaataatgaatttctagcagctaagtgtatcaatatattacacggttttagctaccgttatgatactcactctattggtatttcttttccaaactggtgtaatgagaccgtaggagatcggatttcatttgtaagcatcgaaaaaatggcattagattacctactcactcaaaattactttaaagaaatgcaagatcttggttacttcgatatatcaaaaacattgattgttccaattgaatgtaactttgcatgttttaagcgttatcaaaagatcgacaaatcgtcagcggctggttttcatcgaaagataaagaggcttgctaaaagagcgcataatagaggtgaggtttttgataacaagaagtataacatttacaaacaatgcgatattggacactatcattcattagcagaagaaagtaaaagtaaagggtatggatttagattaaacattcaaagaactaatgaaatcagcatcaataatatacctatttttagtagctatggattagcaaacacagcacacgcattacaatctgttcccataatttaa

SEQ ID NO: 1783 - DNA, 28 bp, Photobacterium iliopiscarium strain NCIMB 13355
gtgtactgccgagtaggcaactgataac

SEQ ID NO: 1784 - DNA, 510 bp, Photobacterium iliopiscarium strain NCIMB 13355
  misc_feature (251)..(260): n is a, c, g, or t
tgttgatacaaccataacttgatattcaatatttttatataaatcaatttcttaataaaaatacaaccatatgttgatattattcaaaacaaccataagttgatattttcataggtttattactaattatgaagattgattgtaagaaagttacttacatcttttttactgtttaagtatatttatggcattagtattgaatattgtaagattctcgctgtggttgaaacaattctgatactagggggatnnnnnnnnnntttaatgctaacgtaacgatgtatatttttcccacgagattttgttaactttctagctggttgagtaaatgcgaactcaagaggagagtctgtttgatatgtcgttgcaggagaaggttgcataaaattgcctctttcaccatatgtagtaaacttacataagtatggtctaaaaagaggcaatatcaagttatggttgtattaaatatcagcttatggttgtaaatatcaacttatggttgtttcaaca

SEQ ID NO: 1785 - DNA, 630 bp, Pseudoalteromonas sp. P1-25
atgtacagaagaaaactcaaacactcccgtgttaaaaaccttcataaatttgctagtcaaaaaaataaatctacctgtttagttgaatcctctttagagtttgatgcctgttttcattttgaattttcaccatcaatagccgcatttgaggcacaaccactaggttatgaatatgagtttgataaccgtatttgccgttacacacctgactttttacttacccacacagacggcacgcaaaaatttatagaagtaaaaccgcaaagcaaaattgctgacgaagactttcgtgcacgttttattgaaaagcaaaccatcgctaagcaagatggacgcgacttaatactggttactgataaacaaatccgtgtatacccaacactcaataacttaaagcttttacatcgctattctggttttcagtctttaacagagctgcaagcatcggtgttagaacttgttaagcaatacggctctattaaagtgggccagttagttaactttttaaaagtaactgccggtgagctacttgctactgtgctacgcttattatcactagggcagttatttgccgacttaactacaaatgaaatatcaatagaaacagcaatttggtctaacaatgtttaa

SEQ ID NO: 1786 - DNA, 1824 bp, Pseudoalteromonas sp. P1-25
atgtttaatgacggtttgtttgatgatgagtttaaccagccattaccaaaagtagaaaccaaactacctcaaaattacgccaaagatttacaagcccttcctgaaaaaattaaaaatacaacatttgctaagcttaaatatattcaatggcttgaggctaatattcaaggtggttggacacaaaaaaaccttgagcctttattgaaagtaatgcctgaagttgagggtgaaaaaaagcctagctggagaacagctgcacgatggtatagcgcttatacaaatgcagataaaaatatcatggcgctaataccaagccatcaaaaaaagggtaacagggagcgcgatacagccaccgataagttttttgaaaaagcacttgagcgttacttagtaaaagaaaagccatcagtggcttctgcttacaagtattacgcagacttagttatcattgaaaacgacagcgttgtgggcagtgttttaaagcctttaacatacaaagcgtttaaaaatagaatcgataatttaccgcaatacgacgtgatggtttctcgctatggtaagcgtcttgctgatattgcttttaataaagtagaagggcatacacggcctacccgagtactcgaaaaagttgaaattgaccatacaccgcttgatcttattttattagatgatgagctacatatcccgcttggtaggccaacacttaccatgttagtcgatgtgtatagccattgtattgttggcttctactttagcttcagcgagcctagctatgatgcagtaaggcgagcaatgctaaatgcaatgaaacctaaaagtgatgtggcaaaactatacccagatacgataaatgagtggaaatgtgctggcaaaattgaaactctcgttgttgataatggcgctgaattttggagtaacagccttgaacttgcttgtgaagaaattggtattaatactcaatataaccctgttgcaaagccgtggttaaaaccctttgtagaacgtatgtttggcacaattaacactgaattattagaccctgttcctggtaaaaccttttctaacattttacaaaagcatgaatacaatcccaaaaaagatgcaatcatgcgctttacaacctttatgcagctattccataaatgggtagtagacgtttaccatcaagatgccgatagccgctttaagtacatacctagccaactatgggagcaaggctttaatacgttaccgccaacagtgctgagtaatgctgatcttcaacaattggatgttgtgctcagtatttcaaaccatagggtgcttcgtaaaggtggaatacggctagaaaacttaagctacgacagtactgaactagccaactatagaaaacagtttagccataaagtatctcaagaagttttaattaaattaaaccccgatgatatttcttatatatatgtttacctcgataagctagagcattacataaaagtgccatgcatagatccaaacggttacacccaaaatttaagtttgaatcagcataaaataaatatacgtattcatcgcgattttatttcgggctctatcgataatgtaggcttagcaaaagcgcgtatgtttattcataataaaattcaaaacgagtttgaagagttaaaaaatgcaccaaaacactcaaaagtaaaagggggtaaagcattagctaagcatcaaaatgtaagtagtgactcacaaaaatcaatagctcagagcgagccattagaacccaaaaaggttacacctaaagagcaaccaacagatagctgggatgactttatttcagacctagatggattttaa

SEQ ID NO: 1787 - DNA, 1002 bp, Pseudoalteromonas sp. P1-25
atgctgaccgataaacaaaaagcaaagcttaatgaatttcgcgatgtatttattgaatacccaataataactactgtatttaacgactttgacagattaagacttggtaaaggattagcgggcgaaaagccctgcatgctgttaaatggcgatacaggcacaggtaaaacagcactaataaaacagtataaagaacgccatttaccgcaatttattaatggagtgatgaaccaccctgtattagtaagccgcatacctagtaatccgacactagaatctactttagccgagcttcttaaagacttagggcaagtaggtagtacagagcgcaagctgagaataaacggtacgcggttaacgacatcattaataaaatgcctaaaaacgtgtggcacagagcttataattattgatgagtttcaagagctgattgagcacaaccaaggtaaaaagcgccgcgagattgctaatcgattaaaatacattaacgatgaagcgggtgtatcaattgtattggtgggtatgccgtgggcagaaaaaatagcagacgaaccccagtggtcatcgcgtttattagtaaggcggcagctgccttattttaaattatcagaaaacccaaagcattttgtacagttaataattggcctagctaaccgtatgccattcaccgaaaagccaaaattaagtgagcaagcaacagtatttgctttgttctcattgtcaaaaggctgttttagaactcttaaatactttttagatgatgccgtactttatgcattaatggataacgcgaaaaccctcacaaccaagcatctagttaaagcatttggagtactgtttcctgatgtaccaaacctatttaccttgcccgttgcagaaattacagcaagtgaagttgagcgctattcactttataaacttgaaagcgcccaagatgaagatccgtttatagcgactaagtttactgaccaaatgccgattagtcagttgttgaggaagtaa

SEQ ID NO: 1788 - DNA, 1176 bp, Pseudoalteromonas sp. P1-25
atgcattttttagttcaaacaaaactttatcctgatgaggctcttgaaagctatttgctaaggcttgctagggataactcatacgatggctatagtgagcttgctgatattttatggcaatggcttgtagagcaagatcatgatcttgaaggtgcgttgccgttagagctgggtaaagttgatgtttatcatgctaggcaagcgagtagctttagaataagagcgcttaagttggtagctcaattagctgatgtaaacgctggtaatattcttgcgcttgcatggcggcgcagtaattttaaatttggcaacttagtagcagtaagccgtaatgagcagacaattcctcttgagttacttcgcactgataatatacctgtttgcattgaatgcttgtttgaatcttcttacgttccttttcattggcatttaaagccctataagacgtgccataagcataaatcacaattaactacacattgtaaggaatgccataacttaattgattacagagcttctgaggagtttttagagtgcagttgtggttgtaaactaaccaatagtgaacagttaaacgatgcagactttaaaattgcatttgcgcttgcaagtagtaacagccataaaatagtggggttaatatcttggtttgcgaaggttaagcaacttgatgtaagcgatgctgactttaaccgtacttttgttgattactttagtacttggcctgaaagccttactactgaattagatttactcacaaacaatgcgcgcctcaagcaacttaacccttttaataaaactaagttcaactctgtttatggaaatgtgatccgtgatggtcaaatagctgcaacaagtaaccgtaaaaacaaagtacttgatgaactaattaaatattttgttgaattagttgatagtaatcctaaaactaaacatccaaatattgcagatttactgctttgtacttttgataccgcagtattattaaacaccaccacagagcaagtttataggcttcatcaagaaggctttttaaactgcgcttacccacaaaaaaagcacgaacagctcagagctgatagtcatgttttttatttacgccaagtgattgagctacagcaagcattcgcagctgaaacgcctcaaacaaaaaaacaatttatagcgccgtggtaa

SEQ ID NO: 1789 - DNA, 2052 bp, Pseudoalteromonas sp. P1-25
atgaacttacaagatgcatttgcaattgaatcattaaaagaaaaaaccacagcacttagaaagttgtttactccatatatgtctcatgttgcggtagatggctttgaagaacaagcgctgactgtgctcattaacctagtttataaacgaagtgagattgatgatttaacaagtacaagaaccgctaaaagtgtattacgtgatgaagtgttactgagtaaatgtattaacgaagttaaatggtttcatactcataatttaaaatatcctgatatacgcgtaagccatcaacgtttaattagtaaggtagtaagtgaagatattgcgggtatttgtagccggtcattacctttaagttttggatggtcgcacaacagtgctgaaattaatcatgcaaagttatttttaacctcatttacttggcaaggtgaagtaacttgtttagcaaatttactaataaatgaagagcctgtttggattaatttaataaggacatacgggtttactaaaaaggcggttttaggcatcgcgggtaaaataaaacagcttttgccagtggcagagctcccattagaagtaagctctttttcaccacaattacaaatgccatttcagcaaagctaccttgcggttacgcctgtagtaagtcacgcaatgctagctaaaattcagcaattaacaacagatcgtaagttaaattttggtttagttgagcactcaagacctgccaatgttggcgatttagcaagctcagtaggtggtaatattagagtgctgcgttactttcctaaaacatattcaaaggctgttaactgctctgaagtattcaataatgatagtgagaaagcatttaaaattcgtgcgctattaaacagtcaatttcaacaggcgcttttggtattggtcggtattaaacagtttaatacgttaaggcaaaagcgattagcgcgagtagcggctattaggcaagtacgtgttagcttgcagttgtggctggataacattctggaagctaaaaataacgctcaagggcaagcttaccctgagtgggcaaagcattacttagatcagagtattactaactgcattagccaatttagtaacgtactaaatgagagccttggtaatttaagtaagctcaaacgctttgcgtatcaccctaatttaatgggggtgtttaaaacgcagttaaactatgtgtttactcactgtattcctgatgaagaaacattaaatgatgagcaaatagtgtatgtgcattgccaagatatgcgagtgtttgatgctgaggcaatggctaatccgtatattcaaggtatgccgtcacttacagctttaaatgggcttgctcataactttgagcgtaagctaaaaaattttatagacccttcaattaagtgtattggtagtgccattaacattgaaagttatcaactacatacaggtaaaccattacctgaaccaagtaagttaaaacaagttgctggccgtagtcatgtcataagatcaggaattatcgataaacctaaatgcgatataacactcgatttagtctttaggctttttgtaccaaacattaagctgttagataagttaaatagtcagcttgtgaaacccgcactaccatctatgtttgcaggcgggactatgcatccaccttcgttataccaaaatattgactggtgccatttacatactaaaccaagtgagctgtttaaaaatataaaggcaaaatcgttaaatggcagttggttgtacccttcaaaaaaagtagtcaaaagttttgaacaattgattgatgcgcttaacggtaactttaatttaagacctgctgcaattggttttgctgcgcttgaagaacccataaagcgagatgtagccttacatgaataccattgttatgctgagcccgtaattgggcttttagagtgtgttagcaatacatcagttaagtacgcaggggctaagcagttcttccatgacgcattttgggttatggatgttcaaaaagagtctatgcttatgaaaaagtctaagtttgagtatgaataa

SEQ ID NO: 1790 - DNA, 1029 bp, Pseudoalteromonas sp. P1-25
atgcaattacctcggcacttaagttacacgcgttcgctttcacccagtaaagcggtatttttttataaaacatcggagtctgattttgaaccgctgcaaatagagcaaaataaattagttgggcaaaagtcagggtttggcgatgcgtatcaaaagcaaaatgtggctaaaaatttagcgccacaagatctagcgtttggaaacccacaaacaattgatgtgtgctacgtacctccagcagtaaatgagctattttgccgtttttcactcagggttgaggctaatagcaatgaaccacatgtttgtgatgaccctaaagttatttattggttaaaacggttttttgaaacctacaaaaaacacaatggtcttaatgaagttgcaactcgctatgctaaaaatatactgatggggaactggctttggcgtaaccgccaatcaccaaatgttgatattgaaatccttactgaacatgcagccccgatcattgttgaaggtgcacaaaaactaaaatggcaaggcaattggcaaaacaatcaaacagcattaataacattatcagaagctattcaagaagggcttagcaatcctcaaaattattgttatttagatataaccgcaaaaattaaaaatgcatttagccaagaggttcaccctagtcaaaagtttgtagacaatgttgaacaaggcatgtcatctaaacaacttgcatacactcaagtcggcgataaaaaagcagccagtttaaactcacaaaaagtaggggctgcgattcaaactattgatgattggtatgagggaggttacaaacctttacgcactcacgagtatggtgcagataagcaaatattagttgcacatagaacgcctaagagccattcagacttttattcattacttccgcgcattgccttgcatattaagcacatggaaaagcatggtttagagcaaagtgaagaatcaaacgcagttcactttattgcagcagtgttgatcaaaggcggcttgttccaaaggagtaaagcttga

SEQ ID NO: 1791 - DNA, 600 bp, Pseudoalteromonas sp. P1-25
ttgaagcgctattattttactattacttatttacctaaaaattgtgatgtaagcctccttgcagggcgttgtatcggcatattgcatgggtttatgagttcgcgtgaaattagtaatataggtgtgtgttttcctaaatggaatgagcaagagataggtaatgaattggcgtttgtatcgacagataaaaagcaattaaccaatctatctcagcaaagctattttgagatgatggctcaggataaattatttggcttatcaaaaatactcgaagtaccaacaaaccaaaatgaggttatgtttattcgcaaccaatcagtagctaaggcttttgttggcgaaaagcaaagacgtttaaaacgcgctaaaaaacgagctgaagccagaggtgaagtttataatcctgaatatcaatttgaggcaaaagacataggccattttcattcaatacctgtatcaagcaaagccaacggccaaagttatgttctgcatatacaaaaaattgaaaatactaatgcgacagaaaatcaatttaataattatggctttgctacaaatcaaacatttcaaggtacggttccttctttgaatacccaataa

SEQ ID NO: 1792 - DNA, 28 bp, Pseudoalteromonas sp. P1-25
gtgaactgccgagtaggtagctggaaat

SEQ ID NO: 1793 - DNA, 510 bp, Pseudoalteromonas sp. P1-25
  misc_feature (251)..(260): n is a, c, g, or t
tgttgtttgaagtataagttgacataaccaaactcggttttattaacttacagcgtggtaagtgaagtgtatattggcatagtattgaagcaatagatggcataaagctaccaaatacagctttataaaacgcaaagtaaacatgctacgcgttgtaaatcactcttaaacagtttggaaaatggtttacactggcacaaaaactttgatgaataaatcatcaccttttactttaattggtaagtccattnnnnnnnnnncggctattgatggtgaaaattcaaaatgaaaacaggcatcaaactctaaagaggattcaactaaacaggtagatttatttttttgactagcaaatttatgaaggtttttaacacgggagtgtttgagttttcttctgtacatgtgagtcaaccatctaaccatttggttaaatactagactatgccaccttatacttccaatttatgccatcttttagtacaaatatgtcaacttatacttcaaacaaca

SEQ ID NO: 1794 - DNA, 633 bp, Pseudoalteromonas ruthenica strain S3245
atgtatagacgcaatcccaagtcatctagagtcaaacaccaattcaaattcgctagtcaaaagagcaagaacacttgtttcgcagaatcagcattagagttcgatgcttgtttccactttgagtattcctcagcgattgtcgcgttcgagactcagcctcttggctttaagtacgactttgaaggccgtacttgcccatatacacctgattttctattaactcacagcgatggcacgcaaaagtatatcgagataaagccggtaaaagagcttgctaaggatgagtttcggcaacgctttgagcagaagcaattggcatcaaagcaactgggtattgagcttatattggtgacagataagcaaattcgagtatttcctgttttagataatctgaagctattacatcgttactcgggtttccaggtattgactgaattacatacggttgtggtcgggttagtaaaaagtactgggttagtgaaggtcgcgcagcttgtaaattacctaaaggtttctgccggagaagttttatccatcgttgcaaggctgttgtgcatcgggcaattggcaacagatctcactacagatgcactttcattagactctgtaatttgggcctcagatgaacagtaa

SEQ ID NO: 1795 - DNA, 1839 bp, Pseudoalteromonas ruthenica strain S3245
atgaacagtaaaagtctggggttgtttgacgatgaattccaacatccgataccccaagtagaagcaccaaaaagcaccaaagctgaaaaagatctcagtgcctacccgcaagaaatacagcagacaacatatgcacggcttaagtacattcggtggcttaaagagcgtatagttgggggctggactgagaaaaaccttgcgccactcataaacgaaatgcctaaagtcgaaggtgcagataaacctaactggcgtactgcggctcgttggtttaaatcttattctgaatctgatgaatccatttttgctcttattcccaaacaccaaaagaaagggaaaagaacacaaagaacagacacagacaagttctttgaaaaagcacttgaacgatttttggtaaaagaaaggccttctgttagctcagcttatcaatattacaaagacttagtggtaatagagaacgaaaaagtaataggtgaagatttaaggcctttaacgtacaaggcgtttaagaaccgaatagataaattaccacattatgaagtattacgagcccgctatggtaaacgtatcgcagatttagcttacaacaaagtagagagccacaagaggccgacacgagtgttggaaagggtagaggtagatcacactccattagacttaattttattggatgatgagttacaaataccgctaggacggccaaccctaaccattttaattgatgtctatagccattgtattgtcgggttttaccttggtttcaatgatcctagttacgatgcaattcggcgggcgatgctaaacgcaatgaaacccaaaaactggataaaagagcagtatccggatataacccacgattggcattgttgcggaaagattgaaaccctcgtagtagacaatggtgttgaattttggagtaatagttttgagtctgcgtgcgcgcagatcggcattagtttgcaatacaacccagttggcaagccctggcttaaaccatttgtggagcgaatatttggagtaataaatacccagttattggatcctattccaggaaaaaccttttcaaatatgatgaaaaaggagggctatgacccaaataaagacgccatcatgcgctttagcgcgtttatggaagtattccaccactggattatagacgtctatcaccaagaagctgacagccgctttagttacattcccgcccttgagtgggatagggggtacgagcagctcccgccagcgccattatctagtgacgatatccaacgattggaaatcgtgctgggtataagcacttggcggcatatccgtaagggcggtattcattttgaaaatttacgttacgacagtaacgaacttgctgattacagaaagcgctttagccccaaggcttcagtaaaactgatgttgaaggtgaatccggaagacctttctagggtctatgcctttttacctgagttagatcactacattgaagtgctatgtatcgatcctaatggttatacagcgggcttgagtctacaccaacataaggtcaatgttcgcttacagcgtgattttatcggttctcatatggatgttgctgctctcgctagggcgaggatgctaattcacgaaaaaattcaaaatgaagttgagttgttagccaactcgacaaaaaaacctaaagcaaggggcggtaaggcattggccaaatatcaaaatgtcgccagtgacaatcttgtatcggtgaagcctagttcacccactaaaaagccacctgagaaagtagaaacagaggaagcgcagaataaaggtgattgggacgacttcgtgtcagatttagagggcttctga

SEQ ID NO: 1796 - DNA, 1002 bp, Pseudoalteromonas ruthenica strain S3245
atgctctcagagatacaaacgcagcgcctaaatgaatttattgacgtattcattgaatacccattaatgactacaatcctcaatgattttgaacgattaaggacgggtcaaaaacttgccggcgagaagcagtgtatgttgctaacgggtgacacaggctgtgggaaatcttctgtaattaaccactacaagaataaacatccggcatgtcacattgacggtgtttaccatcacccagtattagtttcccgcatccccagccgtccaacgttggaatcaaccatagcgcagctacttagcgaccttggtcaggtaggagctgcaaaaaggaaattaaaacgcaatgatgccaatcttaccgattcattaattactaatttaaaatcgtgtggcactgagctcatcattattaatgaatttcaggaactagtggaatccaaccaagggaaaaagcgcaacgaaattgcaaataggctcaaatacctaaacgaagaggcgggtattccgatcgttttggtaggtatgccatgggccgaacaaatagccgaagagcctcagtggtcctcgagattgatggttagacgctttataccttactttaaactctcaaaagatttaacactgttcgttcgggtattgatgggcttggctacacgtatgccgtttcgtgataagccccgtttgcaagagcaagatattgtctatgccttgtttgcggtatcgaaaggctgtttccgtaccttgaagtattttctgaatgaagctgtaaaacaggctttgatgtacggctcagagacgttaaccaagcagcatctcagcgccgcatttgaagtgttttacccgggtatagaagacccgtttaaactatcggtggatgagataacggcctgtgaggtagagagctactcggtatatcacaccgacagtagctcggataacgaggcgcataatcggacgaggtttacggaaaaaatgcctatcaaccagttgctaaaaaaataa

SEQ ID NO: 1797 - DNA, 1179 bp, Pseudoalteromonas ruthenica strain S3245
atgcactttttagttcaaaccaagccctttagggatgaaaccctagaaagctacttattacgtttaacgcgagataacgcttataccgactaccatgagctggccgatattatttggcagagattggttgagtgtgaccatgagttggaaggggcatttccgctagaactgaagactgccaatctataccacgccagccaatcaagctgttttcgcgtcagggcgttcaagctcgttgcgcagtgggctgctctggagccgcttgaacttattcgcttgtcctggctgcgaagcaatactcagtttgggcatttatcggcgcttattcgcgatcagttgctcattccccgaacgctcctaagagagagtcacatcccggtgtgcctaagttgtttaaaggaagagggctacattccctattattggcatttaaagccctacaaggcctgtcacaagcacaaaatgcaattacagtctcattgtgctgagtgtggcgaactaatcgattacagagcgtctgagcggttctctcagtgcaattgtggtgcaaagctaaagactacagctcctgcaagtgaagcggacatagcggttagtgaagggctcagcggtgcggatgcgcacgatttggtgggtaagttgacatggtttgcttaccagtacggccaagaccaagagcacgctagcttcaatgaagctttcatcgcttatttcaaatattggcctgataactttttcgctgagctcgatgaaaaagcatctagggcacgagaaaaacagctaaggccattcaatcatacaaaatttgatagtgtttttggtgatgtgatcaaagtcagcaaagtagccgggcccaatgtcttaagaacgaatattatcgttgattcattactggagtttttcagtgacctagttgagaagaacccaaaacaaaagcacccaaatatcgcagacttgctggtaaatagttcggatgccgcaactttgatcggtacgaccttggagcaggtgtttaggctataccaagaggggcaattgacttgttgcgagaggttgaacaagaacgaacgtttgcagccagacaggtgtgttttctacttgcgtcaggtagttgaattggcgcaatcacaaggacgctatgtcggtgacttcaaaaatcaacttatcacgccttggtga

SEQ ID NO: 1798 - DNA, 2082 bp, Pseudoalteromonas ruthenica strain S3245
atggacttagctgaagcattggcaatcaaatctgtgcgtgagaaatctgatgcgctgcgaaagctttttgctccatatgcttcatccgttgcggtcgacggatatgagcagcaggtggctaccgtgctaatcaacttggtttacaagcgcaatgaacaaattgatctggcaagcatcaaagcggcgaaagatgtgcttaaagatacagagctaatggcgaagtgtatcagtgaggtgaaatggtttcacacccataacctgaaatatcccgatattcgagtcagtcaccaacgcttgattgcacaagtaatcgataaggatattccagctatcaccagcgcttctttacctaaattgctgggctggtctcacaacagtgccgagatcaatcatgcaaaactgtttttgacctcatttaagtggcagggcgaagtaaataatctagcgggtgttttggttgacgaacatcccgcttggatagaagcgatgagaaacttgggtttaaccaaaaagtccgtaatggcattagctacgcatatccgagagttattacctgccactgacttgccgggcgaggtcagcgagttcacccctcaattgatgatgccctatggaaaagactacctcagtgtttctcctgtgctgagccatgcaatgctggtcagggttcagcaactggctcgggataaagtagtgaattggggagtggttgaacatacacgacctgcaaatgttggtgatttacctagttccttaggtggtaatgtacgcgtgctcaggtattttcctgcaacatcgctaaaaggcagcttaggagaatatatagaaaacgacccgaacgaaagactattcaagcataaggtactaacgagcaaaagctttaaaacgtcacttattattttgactggtaaatcagtttataacaccttgaggcagaaacgattagcgcgtattgctgcgatacgtcaattacgaagtactttgatgcactggttagataaaattatagagtttcaaaataatggtaaccacaatcttgtgccagagcctatgaagtcgttcatagaaaatttgaaaccgaatcttaatggtgtagtttgcgagttaagtggcttgttgaatgagcagttgtcttcccatcactcattgaagaaatttgcataccatcctgacttaatgtcggtattgaaacgccagctgcaatatgtgctaacgcacggggaaacggtagacgagaccttagttgattctcaaattttgtacgttcactgtaaagggcttcgaatatttgatgctgagggaatgccaaatccttatttgcagggcattccgtcgttaaccgcattggcgggagttgcacataaatttcagcgcaagcttcagtctattgttgacccttctatcgagtgtattggttcggctatattcgtacacagctatcaattacataccggcaagccattgcctgagcagaatcagcttaaaactaaccaaggaataacctcggcaaaaagaccggggatagttgataagcccaaatgtgatatgacgattgatttggtatttcggctttttgtgcctcacgagagcactcggactcaattaaccgacaatatgtttaaggcagctttccctacctcttttgctggcggcaccatgcacccgccatcgctgtatgaaaccgtcgagtggtgccaggcattcaccagtccaacccagctttttggagaactgagtttgctgccgtcgagaggttgttggctttatccttcaaaacaccaggtgagaacgttcgaagacatggtggaattactagacgcagatccaaatcaacggcccgctgggttagggtttgcgtcactggaacagccgacccagaggaaagaggcgttaggatctaagcattgttatgttgagcccgcaattggtttattagaatgcgttaacccaattactacacgcatgggaggagcaaaggcattctttcataatgccttctgggtaataggagtcgagaaaacgtctatgcttatgaaaaaagccaagtttgagtacactcaatgcgactcccgcgacacctaa

SEQ ID NO: 1799 - DNA, 1029 bp, Pseudoalteromonas ruthenica strain S3245
atgcgactcccgcgacacctaagttatacgcgttccttgtctccgggcaaggccgtattcttttatcaaactcctgaatccgacttcgaaccattgcagatagagcagaacaagctgattgggcagaaatccggttttaccgatgcatatcaaaagctcggagaacccaaaagccttgcaccccaagatctagcttttgggaatccacagaccatagacgtatgctatgtgccaccgactgtgaatgagattttttgccgtttttctctgcgggtagaggcgaacagtgttgaaccatacgtttgcgatgaccgtaaagtgagctattggctgaagcgctttgtcgagacctacaaggagcatggtggttttaaagaattagcctcacgttatgcgaaaaacatactgatgggaaattggttatggcgtaataagcaatcaccgggctttgatgttgaagtgctcacggaacactcagaaccaatcgtgattgagggtgctcaaaggttaaaatggaatggcgtttggggaaacgatgaggctgcattagcaaccttgaccgaggctattgaaaatggtttggctaatcctcaggcctattgctatttggacattaccagcagaattaaaacggccttttgccaggagatccaccccagtcagaagtttgtagacaatgttgaacaaggaatgtcatccaagcaactagcctacactcaggtggatggtaaacaagttgcaagtttgaatgcgcaaaaagttggcgctgcaattcaaaccatagacgactggtacacagaagatctcaagcgtttgcgtattcacgaatacggtgcagacaagcaggtattagttgcgcatagaacgccaaagaatggtttggatttttactctctacttccaaaggtcgctgtttatatcaggcatatggagagggatggtctggaagatgatgaagagtctaagcacattcactatctggcatcgatcctgttgaaaggtggtttattccaaaggtctaaaggatga

SEQ ID NO: 1800 - DNA, 606 bp, Pseudoalteromonas ruthenica strain S3245
atgaagcgcagctatttcacggtcacctatctcccaatcaattgcgattactcgctgcttgctggcaggtgtattggcattttgcatggctatttaagcagatttgaacttgatggaataggtgtgagttttcccaaatggaacgaggagactgtaggtaatcaaatcgcatttgtctccgagagcgagagccatttacagacactacggcagcaaaactactttcagatgatgagccatgacggcctattcaaattatctgtgactagaacagttccagagcaggttgatgaaattcagtttgtgcgcaaccagtccatatccaaagcctttgtcggcgaaagacgcagaagaatggtaagggcaaagctaagagctgaagcccgaggggaagagtacaacccgatttatgaatttgagcccacagaaatagagcattttcactcaataccgatcacaagtaaaagcaataacaatgagtttgtattacatatccagcggcgggaatgttctggtacagcgggtggatttaataaatacggttttgccacaaacgaacatcacctcggtacagtaccgagcctttctggccttttaattagttaa

SEQ ID NO: 1801 - DNA, 26 bp, Pseudoalteromonas ruthenica strain S3245
gtgaactgccgagtaggcagctgaaa

SEQ ID NO: 1802 - DNA, 510 bp, Pseudoalteromonas ruthenica strain S3245
  misc_feature (251)..(260): n is a, c, g, or t
tgtcgtttgaagtataagttgacataagacgggcccttgccctaggctctatctgggtgttacggaagtataagttgacataagtttgaagtaaaagatgacaaaaagtcccttactgtcctaatattgcccctcgcgcgtaccttttgtgcattttcagtcgttcggctagtgcgtcatacaactaattaaataatcagacgttcacaccaattcatttttggacagaaatgagttagagccgaccagtnnnnnnnnnngacaatcgctgaggaatactcaaagtggaaacaagcatcgaactctaatgctgattctgcgaaacaagtgttcttgctcttttgactagcgaatttgaattggtgtttgactctagatgacttgggattgcgtctatacatagccgtttctttttttagcgcactgactaaaaaataggctatgacaacttattgttcaaatttatgtcaactttaacttcaaatttgtcaacttatacttcaaacaaca

SEQ ID NO: 1803 - DNA, 630 bp, Photobacterium ganghwense strain JCM 12487
atgtaccgccgaaagctcaaacattcccgcgtaaaaaatctttttaagttcgtcagtgccaaaatgaatcaggctatgacggttgaatcctacttagagttcgatacctgctttcacctagaatattcatcatccatcatctcttttgcggctcagccggaaggtttcatctatcgtattgatggccgagattgctcttatacgccagattttcaaatacttgaaaatgaagaggtaaagtggattgaagtgaagcctttcgtgaaaactcaacgtccagattttcttcagcgttttaaagtgaaacaagaaaaagccttagcgcttggtgttcctctcattttggtgacagagaaacaaatcagggtgaatcccgtcttgaataatctcaagatactgcaccgttattcgggttttcagtcgcttacagatttacatatccgtcttttgtcattggttaaaacggtcggaaaaataagcgtgagtgatgcagcctgtcggttaggtattgatcaggggatgatggtgaaatcggcttttagcttggtgtcatccggtatgctaacggctgatttagtacatgatgaattgggtttacattccattgtttggagtgaacacaatggctaa

SEQ ID NO: 1804 - DNA, 1868 bp, Photobacterium ganghwense strain JCM 12487
atggctaaagatatcagtaccggactttttcaagatgagatggcagttgcatccagcagtgagccagttgaagcattacccagttcaacggatgattttttcgaacgtgacctcgcttcttatcctgatgaaattcaaatagaagtcagacgtaggattgaataccttcaatggattgaaaagcaccttgtcggaggctggacacaaaaaaacttagacccactgattgaaaaagcagccagagaaatagactttcctcctccaaaatggcgagcattagcgaagtggtggagtgtctattcatcatctgggaaaatgttggcgtcattagtgcctaagctgcatcgtaaaggtaatcgaaatctaaaaataaccaatgaattatcattttttgatcgcgctgttgaacgttatttagtccccgaacgtccttctatttccgctgtttatcagtattacaccgatcttattcgcattgagaatcagcatcttgtcggcgagaaagttcaagccctctcatacaaaggcttctataaccgaataaaaaaatgccagcttatgaggttgcagtagcaagacatggtaaatacctcgctgacatggaattcaacaagatcgatgcgcatcaaccacctagccgagtattggaaaaggttgaaatagaccattcaccattagatcttatcctacttgatgatgagctaaatattccgctaggacgcccttatctgacactactgattgatcagtacagtaaaagcattatgggttttcatttagggtttaaagaacccagctactattcggtaatgaaggccatccttaatgcgataaagcctaaagatgatattgcggagcgatttccaggtgttgtgcatgactggtattgtcagggcaagatggagtcactggttgttgataatggggcggaattttggagtaagagtcttgagcagtcctgccttgaagttggtattcatattcaatataaccccgttcgcaaaccttggttgaagccgttggtggagcgaatttttagaaccatcggcagcaagttgctagtgactattcccggaaagaccttctctaatattttagcgcgtgaagagtatgatccgcgaaaagatgcggtgatgcatttttcagtattcaatgaactgtttcataaatggattattgatgtgtatcactatgaatcggattcccgaaagcgtgcaattccttatgtgaaatggcaggaaggggttgtggtgatgccacccattagttatgagccggaagatctggaaaagctatctgtggttttagggatcaaagaattacgcaaacatcgacggggtggtattcaccttcatgggttacgctatgacagcgaagagttagcggattaccgccgaatgtactcgcgagatatcgacgtactcacgaaaactaaccctgatgatatttcaagcatttatgtctatttagagcataagcagcaatacttgaaagtgccatgcatcgaccctatcggttacacgaagagcctatctctcactcagcatcatattaatcaacgcttgcatcgagatttcattgacagtcaactagacctagaagggttggctcgcgtcagaatgtatattcatgatcggattgaacaagaagcagacgagattaagaaccttaaccgagggaggcctcgacgtactacaaaaggtatggcgagattagctaaacataacggtgttgctagcgatgttcaaaccagttgtgtaccagaaacactaccggaactgtcgatgccagataaagggaaagaatccaaacagttgccggactctgatgaatgggatgatttcatatctgatctggaaccatattga

SEQ ID NO: 1805 - DNA, 1017 bp, Photobacterium ganghwense strain JCM 12487
atggatagtttgtctcctgaagatgaagcgaagtatcaggcgtttgttgatatttttgtcgagcagccgatagccacaatggttatggctgattttgaccgattgagatacaaccgacaatttggtggtgatcagcaatgtatgttactcacgggagatacgggttctgggaagtcttttttaatcaaagagtattgtcggcgtcttgctcaaaccaacccaatgaaacaagcattggtactttcaagtcgcatccccagtaaaccgactcttgaatccacgatcattgaattgctcaaagattttggccattttggtgcgacgtaccgaaaagggaaaagcaaagatcaatccttaaccgtctcattgattaaatgcttaaaggcatcttgcgtagaactcattatcattaatgagtttcaggagttggtagagtttaaaacagggcgagcattgaatgagatagcaacgcgcttgaagcacatcagtgaagaggcgacagtaccaattgtgttggttggcatgccctgggctgcgaagatagccaatgagccgcaatgggcgtcaagactgcttatcaggcgagaattaccatactttaaactctccgaagaaccagaacacttcatccggtttatcaaagggcttgccgccagaatgccttttaccgaactgccaaaactggataacaagcagacgatactggctctgttctctgcctctaacggccagactcggcgtttaaagcaattattaaatgaagccgttaaactggctttagttcagaatgcggtgacgttaaccaatgaacatttagcggatgtcttccgtatgatattccctgccatccctaatccattcttagcgtcgatagagcaaatagaagggcaagaagtgagtttaccctctcattacgacagtggtgcagacaatgaatttgaagccattatcccgactcagtacacagatcgccttcctttatcgcaactattgcgtaaaagtagaaaaactaagtaa

SEQ ID NO: 1806 - DNA, 1218 bp, Photobacterium ganghwense strain JCM 12487
atgtttctcattcatcccgaaaaacactaccaagatgagtcccttgaaagctttttgattcggctttgtgagtgtaatggctttgagtcgtttcggttgttgagtggtgcgctatgggaatggctcgttgataacgaccatcaagcagcaggggcgctttcccgtcagttgtgtgagataaacctttatcatgccaagcattccagtggttttagagtacgagcttttgagctactagattcattgtttaaggggaacgctagaccattgatgcaacatgcgctgttgcattcagccgtaactttttcccccaacttaacgtcagtctttcgggctggtatacatatccctcgctgttttcttcggcaaagttacacgcctgtctgtccggcatgtttaacggaagctccatacattcgccaatattggcacttaaagccttatcagagctgtcatcgtcatggtgttgccatgttgttccattgcccatcatgcagtgccgttctgaattatcaagatactgagcaaatcgagacttgtagttgtgggtttgatcttcgtgatgcagggacaaatgttgcttcatcagagcaaattgcaatcagccagcttgttgttgaaggggaaatgcaaaatgctctctcaattagtcattggttaggcgcactactttggttttatcggtacaagcagtctcagctttctctcaatgtggtcaaagaacctgagtttggccgggcagttgaatatttttcacagtggcccaatgcgtttgtgcgtgatttgcatgagttggctacacaggctgaaatgaaacttgtcagaggatttaatcacacgcgcttttcggaggtatttggcgatctcctgagttcatcacgtaaattgccatcgagcgatactcaacaaaatttcatcctcaaggccgtgatcgattttcttcagcagttggtgcgagataacccgaaagccaaagagacgaatattgctgatgtgaagttgacggtcgtggaggccgcagccctgttaacaacttcgacagaacaagtgtatcggctttatgaagaagggtacttgcaatcatctgtgcgttttaaactgcattcaaagttatcgcctaatgatgcggtgttttttctacggcatgttgtggagttacgtatggctgggatggcatcggattacagtgctaatgatgtttatcttccatcatggtga

SEQ ID NO: 1807 - DNA, 2076 bp, Photobacterium ganghwense strain JCM 12487
atggtgagatcaatgcatttatcggagttactactcgttcaagatacagaagaacgcaatcagttattgagaaaagcacttgcgccttatacatgtctcgttgacgtaacaggctatgaacgccagctattgatgattgctattaatataacggtgccgagaaaagatgtagacgatgttttggataagaagctagccaaatcattgctgaccaatacaaagcaccttcaacgttgtattgatgaagtgcaatggttccatacccacaatgtgaaataccctgattctcgggtaaaggggcaacgcattatctccctgaaacaagatgaggttgacggggttttgtgtagtgccaatcttccttcatcattgggttgggcgcataacagttctcaggttaatcctgctaaatttttctctattcgctttatttggcaaggccgagcaatgtcactgcttgagaccgtgattgatgctccttctgaatggaaggtggcatttcgatctttagggataataaaaaaacagttatcggagttcagggaaatattttcgacctactatacctctagtcagatcccatctgaagtcagtgattattcaacgcaaatacgcgtgccatatcagggctattattgtgctctaacccctgtcatcagtcacagcgttcaatcgaaaatccaaaagatggcatttggccgaaaggtgaaatcgagcaatgtagaacatcatcatcccgcgagtgtgggaagtttggttgctgcgttaggggggaatattcgggtactggattatcctcctaatgttcgtcagaaaacatcagaagctttttcactgtaccgagcggtaagtgaaaaggaggtatttgatcactcgattattaaagagaagcgctttctggatgcattgagtcggattgcgggagagaaccctacaccaacactgaggcagcgacgacaactgcgagtatctgcattacgctttgtacgaaagcagcttgccttatggctagctccgatgatggagtggcgagatagtattggtggggaatctcgtcattctcccattgaaacactagaagaacagttgctttacctgcccattgcacacttaccggatgtccttagcgatttaaacacacgttttcatcaagcattgcaataccatcgtcgaggggcgcgttatgcctaccatccagaggtcttgtttccgattaaacagcaattgaaatggctgcttcgttatatggcaaatcaacaagatgcacttataacgcctgagccaaattgtgtgtacctgcatcttcagcaacttgtggttcatgacgcttcacttctgtctaacccttatgtttcaggaatacctgccttaacagcgttggggggattgatgcataactatcagagaagattgagtgcattgatggagtgtgaatgcttaattcaacgaggtgcttggtttattgcccactatcatcagcagaagatcaagaagcttcccgaaccggataaggtgagatatctgaagaaaagatcagatgttcagcgaccaggtattaccgatggaaaatatggtgacttaaccatgaatttggtgctggaattacagttacccgagtcagtatcaatacctgaactatcccttttacaagccgcgttcccatcgcgttttgcaggcgggacgcttcaccctccatcattgtttgagcaaacagattggttatcggtttactccaaccaaagtgaattgttttctgttttagctcgcttacctcgaagtgggtgttgggtttatcctgatgataaaggtgtgagttcgtttgatgaactggcttctcgtttggataatgaccctgacttaaagcctgttggtctgggttttatcccactggaagagcctcattgccgagtagggagtatcgcgccttaccattgttatgtcgaaccatgcattggtgttgttcggtgtatgaaccccattaacgttaggctctcaggtagccagcaattctatcagtcggctttttggcactttgatattgcaaatgacgctatgcttatgaaaaaggcaacatga

SEQ ID NO: 1808 - DNA, 1035 bp, Photobacterium ganghwense strain JCM 12487
atgcaaatttgccgccacttaaactatgttcgctcattatcaccgggaaaggcggtgttttactatcaaacacccgagtctgattttgtaccgattcaggtagaaacgaaccgaattagagcagcaaaaagtggttttactgaagcgtatgataagaaccaaaatctcaaaaatgttgccccgcaagatctcgcttacagtaatcctcagtgcattgatgcttgttatgtcccgccgaatatttcagagatacattgccgtttttcactcagagtagaagctaactctcttcagcctgatagctgtgaagatcagaaagtaaggcgatatcttattcaattagcatcaatttatgcgcaagtgggcggctaccaagaattggcaaagcgttactgtaaaaatattctgatgggtacatggttatggcgcaataatcacacgttaggaactcggattgatgtgattacgtcgagtggccgctgttacgccattgacgatgcccgttatttggattggattgattggccggaagaagaacaagtaatgctgaatgacttggcttcagaaatggcggcggcattgtgtgaacccaaacaattttggtttgcagacataaaagcgacgttgaaaacggggttttgtcaggagcttcatcccagccagaagtttactgatagtcatgaacaaggagagtcatctaaacagtacgccacggtagaatgtcctaatggtattcaagctgcatgttttcatgccgagaaggttggggcggcgctacatctgattgatgattggtgggatgaggttgcagataagaggctgcgaactcatgaatacggggcagatcgagactacctgatcgctcgccgccacccaatgaagaagcaagacttttattcgttactgacactaactgctgtgtttatcaggcagcttaggaacgtcagggataaagggggggaaattccgcctcaagttcattacctaatggctgtgttgtgcaaagccggtatgtttcagcgaggtaaaagctga

SEQ ID NO: 1809 - DNA, 624 bp, Photobacterium ganghwense strain JCM 12487
atggctaatcgtttttattttctgattcgttatatgccagaagatgtggatgaggggttattagctgggcgttgtattagtatcttgcatggtgtgttgtcctcggatcagaatgatattgatggcggtattggcgtggtttttccgcaatggagctgtacgtctttagggcggagtatcgcatttgtttccgataatcagcgacatttagaacagttaagccagcaacattactttgctgtgatgaagggggataacctctttgatatctcgcatatccaagcagtaccatcaggcttatcagaaatacgattcaaacgtaaccaaggaatcgcgaagtgctttgcaggtgaaaaacgtagaaggttagctagggcaaagcgtcgagcagaagcaagaggtgaagtctttaatccaaagcacggtatgtcagatcgtgaagtgagcctatttcacaaagcggttatgaccagtaaaagcacaggccaaaaatacttactgcatattcaaagagaaacagttacaggatcgagtgtgagtcagtattcgcaatatgggctagcaaccaacattgagtgcatgggcacggtgcctgatttaagtccgataataccctttttttga

SEQ ID NO: 1810 - DNA, 28 bp, Photobacterium ganghwense strain JCM 12487
gtgacctgccggataggcagctgagaaa

SEQ ID NO: 1811 - DNA, 510 bp, Photobacterium ganghwense strain JCM 12487
  misc_feature (251)..(260): n is a, c, g, or t
tgtagcttgcaccataaggctacatagccaaccacttataaatcagaagcttagttatttctcttcaccataagcatgcataaaaaggcagcataacccgacataacactacatgcgaacattctgcctctcagttacatgtaagttattttcttacatgaagaacagaaccagatgcctcaaagaaacaaaacccgcatcaagcgggcttatcttgcttagagctattaacgactcttattggattgcgnnnnnnnnnngatggatgatgaatattctaggtgaaagcaggtatcgaactctaagtaggattcaaccgtcatagcctgattcattttggcactgacgaacttaaaaagattttttacgcgggaatgtttgagctttcggcggtacatagtagaccagcctgtttgttgttaaactacaacaaaaatagcttatgcacgcttattgtaccaattatgcagggtatcaaggaagatatgcaggcttatggtgcaaactaca

SEQ ID NO: 1812 - DNA, 630 bp, Shewanella sp. UCD-KL21
atgtatattcgaaatttacgtaagccttcgcccaataaaaacgtctttaaattcgcgagtgcaaaagtgagcgaaacgataatgtgtgaaagtacattggagttcgatgcatgtttccaccatgaatataatgagacaatcgagacttttggcagccagcctaaagggttttattactgttttgaggggaaaaggttaccttatacgcctgatgcgttacttcactacattgatgggacgacaaagtttcatgaatataaaccttacagcaagacattcgaccctatttttagagcaaagtttgtagctaagaaagaggctgctcaggcactcggcactgagcttatacttgttactgataagcaaattcgtgtaaatccaatcttaaataatctcaaattgcttcatagatactctggtatctatggtgtgactgatatccaacgtgagttgctacagttgattcgacactcaggaaagattcagttggatgatgttgctgatgaatatgagctttcagtcggtgaaactcgctcgtttctttattcactaatcaataaaggcttgctagaggcagatctaactcaagatgaccttagctgtaatccatttgtttggtgtaatgcatga

SEQ ID NO: 1813 - DNA, 1854 bp, Shewanella sp. UCD-KL21
atgattgaatttaaagatgagtttacagagtctacatctgtcaaaaagcccgatacccctggtcaatacatcaagttagatgatgctgagatacttaagcgcgatcttgatacttttcctgactttcttaaagaaaaagcctttgataaatataaactaattagttttattgagcaggaaaactcagggggatggacgcaaaaaaagctagatccaattcttgataaactatttgaaggcaatagagataaacggcctaattggcgtaccgtggttcgttggcgtaagagttatatcgatagtaatggtgatttagcctctttggttgttaagcgccataaaatgggcaaccgaaagaaacgagtggaaggcgacgaggtattttttgagcgagcattatctcgttttctagatgccaaaagaccgaaagtgacaacggcctaccagtactataaagatgccatcacgattgagaatgaaacaatcgtcgatggggaaatccctattatttcctataccgccttcaatcaaagaataaagtcactgccaccttatcctatagctgtcgctaggcatggtaagttcaaagctgatcagtggtttgcatattgttcttctcatataccaccaactcggattttagaacgggttgaaatagatcatactccacttgatttaatccttctcgatgatgaattacagctccctcttggaagaccctacctgactttaatcgttgatgtttttagtaattgtgttttaggttttcatttgagttataaagctccctcttatgtatcagcggctaaagctattgtgcatgcgataaagcctaaaactctgggtattgtcggaatagagcttcaaaatgattggccttgttatggcaaatttgaaaccttagttgttgataatggagctgagttttggtcaaagagtttagaccatgcttgtaaagaagctggtataaatattcaatataaccccgtgcgtaagccatggttaaagccgtttgttgagcgtttctttggcatgattaaccaatattttttaaccgaactcccagggaaaacgttttcaaatattctagaaaaagaagactacaaacctgaaaaagacgccattatgcgtttttcagtatttgttgaagagtttcatcgttggattgttgatatttatcatcaggattcagactctcgagatacgcgtattccaataaagcagtggcagcatggctttgatgtctatcctccattgcagatgagtgtggaagatgagaaacgttttaatgttctcatggggatcactgatgaaagaacattaactcgaaatggttttaaattcgaagagttgatgtatgactcaactgcattagcggattatcgtaagcactacccacaaactaaagacacaataaaaaagctgattaaaatagaccctgatgatctctctaatatccatgtttacctcgaagagttagagggctacctcaaagtaccttgtaccgatactacagggtatgccaatggtttgagtctgcatgagcataaagtgattaagaagattaaccgtgaaattatacgcgagagtaaagacaacttaggtttagccaaagctagaatggcaattcatgctcgagtacaacaagagcaagaactctttaatgaatccaaaacgaaagctaaaatctctgcagtaaagaagcaagctcaactcgccgatattagtaacaccggtcaaggtactattaggcttgaaaacagtgacaccctttcagacataaccaacaaaccagagtctaatatcagtgatatcctcgataactgggatgataatatagaggggtttgaatga

SEQ ID NO: 1814 - DNA, 1032 bp, Shewanella sp. UCD-KL21
atgaataccttaaccgctcatcagatggagcaattgggcaggtttaatgattgttttgtcatgcatcctcaagctaaggtcattttcaatgattttgatgatctaaggttaaatcgaaactttcaatcagaccaacagtgcatgttgttgaccggagatacaggtgtaggtaaaagtcatctgattaacaactataaaaaacgagtgttagctagtcaaacatatagccgtacttcaatgccggtattagttacccggatctcaagtcataaaggtcttgatgcgactctgaggcagatgttaactgatttggaatcatttggcagccaacaacgaaaagggcagaattataaaatagatttgaaaactcaattggttaaaaatttagttagagcgaatgtagagctacttattttcaatgaatttcaagagttaatagagtttaaaacacctaaagagcgtcaaacaatagctaatgaattgaaattcatcagcgaagaagcaagagttccaattgtcttagttggcatgccttggactgaacaaatcgctgaagaaccacaatggtcatctcgcttaatacgtagaagaaagcttgaatattttagtctccaaaaagacagtaaatattatcgtcaatatctaataggcttagccaagcatatgccctttgatgagcctcccaagattgaagataaacatattgctataccattatttgcagcctgccgaggtgaaagtagggtattaaatcatctactatcagagacattaaaacttgtaatggtgaatggtgatcgcagtcttgatattaggcatttagctcaaacttatagaaaactttatgagagtcaggaaagtgaggctgcttcggttttttttaacccttttcttgagccgctagataaggtccttatttcagaagttgttaagccatcccgatataaccccaatgcgatgacccctgatgagatgttgattaagcgcgagttttctgcgccgagtaccttagctcaattactcagtaaatga

SEQ ID NO: 1815 - DNA, 1236 bp, Shewanella sp. UCD-KL21
atggcttttcttttttctcctaaagcgcgatcatttagtgatgagtcacttgagagttacctgctgcgagttgttgctgagaacttctttgattcctatcagcagctgagtttagccataagggaagagttacatgaacttgattttgaagctcatggcgcatttcctgtagaactaaaacgacttaatgtttatcacgctaagcacaatagccactttagaatgcgggcattaggcttacttgaatctctccttgatttgccgcctcatgagctacaaaagctagcactacttcgctcgaacaaaaggtttgttggaggtatgtcggcagtgcatcgtaatggtgtagacattccattgagctttattcgttgcgctgatgaagacggtatcgaaagcctacctatttgccctcaatgcctgaaagaagagccctatattcgtcaggcttggcatattaagccaattgaagtgtgtgccaagcatgagtgtgaactgattcatcattgccctgattgccaacaacctatcagttacattgagaatgaatctattactcactgctcatgcggttttgagtttgccaccgcttcgagcgagaaagccgatagccaagcggttgtattgtcccgtagcttgtttgatggtgatgcattatctaacaatcctctgttatttatgggtacttcagtgactcatcgatttgccgctttgctttggtacctgaagcgtcatgttcaaaatatagagtgtaagttggatgagtctgtaaattactttgaagcttggcctgaaaacttttatcaagagttagatgagcttttagctggtgctgagctgaagcttattgatttgtttaatcgaacgtctttgagttttatttttggtgagttgattttacagtctcaatgtttattgccagaagataaaacaccacactttatcgatatggggttaatggaataccttggcaaattagttgagtcacatcctaagtctaaaaagcctaatgtggctgacatgttggtgtctgtgactgaaaccgcagttttgctctctaccagtcatgagcaagtgtatcggctttatcaagatggtgtgttaactgctggatttaaacaaaagattcgcactcgaatcgatcctcatattggtgtgttctacttaagacaagttattgagtacaaaacgagttttggtaacgataaacaagggatgtatttatcagcatggtag

SEQ ID NO: 1816 - DNA, 2100 bp, Shewanella sp. UCD-KL21
atggtagataaactaaaattccacgaattgctcgatattgacgatatctctgagcgtaatattgctttaaggcgagcatttactggctatacagtgccgatggatgtgacgggcaatgaggcctctgcgttaactattttacttaatctgacttaccctagaaaacgggttgatgatctacttgataaacggttagccaagcagacactcaatactgatgcacatctagatgccagtattgacgaagtgcaatggttacatacgcataatttaaagtatccagacatacgagtaagcaagcaaaggctgattacagcatctccgctatcacactctcatatattgagtagtgcaaactgcataagcaccttgggttggtcacatgacagtgccaaagtgaatttagcaaagttgttttcatgtcattttaattggcaagaccgtgtttgttgtcttgcaactttgttgtcagatcctcctaaaatttggaaagaagcttttcaagcgttaggcatgcttgtgaaggactttatgaatttgtgtggcaggattaaagcttcattgcctagctatgagagtcccagtcgtgtcgataaatattcgattcaagttcgcctgccttatcgagatggctatttggcgatcacaccagttgttagccatgcacttcaagctgaaatacaacaagctgcaatggctaagcagtgccgatacactaattttgagtttacacgtcctgcggctgttagtgagctgtcggcctctcttggtggtaacgtcaaagcgctgaattatccacctcggataggaaatgcagtgcatggattaagtgactcttggttattaaaatttcaagcaggtcaaacagtattaaaccaaggtgcgttatcacaacctcgatttaagagagccttagagggtcttctatcaaatggttttgaactggcattgaagcaacgcaggctgcataaagtagcaagcatgaggcagataagagcaaccttgactgaatggttgtcaccattattagagtggcgtttagaggttgaagagaacaagaataatgttagcgaactcgcctgtattcatggctcatttgagtatcagtttttaactgcgcaaaaagaaaaccttgtcgggttactaaacccaatgtttagcctgttaaatacaatcttgtctaactcaaacacattacaaaaatatgccttccatcagcgtttgatgaggccactgaaatgtagtttgaaatggttgctcgataacctctcgaaagaatcgaatgcaatagattcagatgaagacaatcaacagcgttatttgtatttgaaaggcataagagtatttgatgcccaagcgttatctaacccttattgtgcaggtttaccttcattaacggctgtatggggcatggttcataactaccaacggcgattaaataaaaggctaggtactcagcttagattgacctcattttcatggtttattcgccagtactcatctgtagcgggtaaaaaactgcctgagtacggtatgcaagggcaaaaagaaaaccagtttagacgggctgggattgtagataacaaacattgtgatttagtgtttgatcttgtagtgcacattgatggctatgaagaggacttagatgcaatcgataattctacagatgctataaaagccagttttcctgcaacatttgccggaggtgtaatgcatcctccagagatcggctcagtcgatgagtggtgtgagctgtatcctagtgaaacatcactttattcgaagctaaggcggcttcctgcatccggtaaatgggttatgccaactaggtatcaaatggatagccttgatgggttgctgcagctattgaagctaaatgtagcactctgcccagtcatgtcaggatatctgatgttaggaccccctgaaagccgcaagaattcgttagagccattacattgttatgctgagcccgcgataggagtggttgagtgtgccactgctattgatataaggttgcaagggatgagtaacttttttagacgggctttttggatgctcgatataaaagagacttcaatgctaatgaaacggatttga

SEQ ID NO: 1817 - DNA, 1098 bp, Shewanella sp. UCD-KL21
atggagttatgtaatgttttaaagtacgaccgctctttgtacccaggtaaggcggttttcttctacaaaacagctgaaagtgactttgtccctcttgaggctgaaatcaatcgaattcgaggtcaaaaagcaggctttacagaagcctttactcctcagttcaaatccaaaaacttagcaccccaagatttagcccactgcaatccccttatccttgaagagtgttatgttccgccaaatgttgagtatatttattgtcgtttctcattgagagtacaagctaactctcttaaaccagctggttgcagcgaaccgacagtatttgctttacttgaagagttcgctgccatatttaaagcgtgtggcggttacaaagaactagctactcgatactgtaaaaacgtgctgttaggcacctggctctggcgtaaccaaaatacggggaactctcaaatagatattaaaactagcgctggtaattgctatcaaatagctaatactcgccaacttgcttgggacagtcgttggcctgccgatgctcagcaagtattggaagagttaagtgatgaggttcatcaagcgttaactgatcctactgtattttggcatgccaatatcaccgcaaaaattgaaacggctttctgccaagagatctatccaagccagtcttttggcgaaaaggcggcacagggtgaagcatcaaaacaatttgctaaagtgaagtgtgttgatggtcgttatgccgttagctttaattcggtaaaaatcggcgctgcactgcaattaatagatgattggtgggatgttgacgattccaagcgattacgtattcatgaatacggtgcagacaaagaattaggtgttgcgcgccgagctcccgaatctaagcagagtttttattctctatttatcaatacagagctctatcttgcagagcttaatcaacagctcgctgaggatgaatattccattagcccaaatatttactatctgtttgcggtgttaataaagggcggcatgttccagaaaaaggctgaagctaaaagcaaatcaaaagccgaaacctccaccgctaaaataactcctgctaaggcctag

SEQ ID NO: 1818 - DNA, 600 bp, Shewanella sp. UCD-KL21
atgcatcgatattattttatggtgcgatttttacctgaacaagcaaacttagctctgttaatgggacgctgcatttcaatcatgcatggctttatttgtaagcatgacattcaagggcttggtgtgagttttccagcttggtctgatgcatcaataggcaatatgattgcttttgtccacacagatatagctgcattgaacgagttaaagctacaaggctattttcaagatatgcaggagtgtggcgtttttaaagtcgataatgttgaagcggttcctgatgattgcgtggaagttaggtttaagcgcaatcaaggtattgcaaaaatgtttgttggtgaagctaggagacgattaaaacgtttagaaaaacgtgctctagcaagaggggaggtttttaatccaaataaaaacgatgagccgagagagttagattgctttcattgcatagcaataggaagcaccagtactgaacaggattttcttttgcatgttcaaaaagaaattgtacaaaagtacgaagaacctgagtttaatcaatatggattagctacaaataagttactgagagggacagttcctgaatttagtgaattttaa

SEQ ID NO: 1819 - DNA, 28 bp, Shewanella sp. UCD-KL21
gtgaactgccgaataggcagctgaaaat

SEQ ID NO: 1820 - DNA, 510 bp, Shewanella sp. UCD-KL21
  misc_feature (251)..(260): n is a, c, g, or t
tgtcgctggaagcataacctgacataggtcgcttcaaactttcaatagcttagttgaaaaatataaccatatcctgacataaaatataaccgtaagctgacaaattgaagcaatctctggagccaaaacttttccatgtacttttatgacaacataatgcgacaaatatcatttacattatatgatttagaagaatggcaataatttagctattctcattctttaaaactcaagacctactcctaactcgnnnnnnnnnntattgggcgaaggcttacgtaaatttcgaatatacatgcgcaaaactcaagcaacttaggtacacttagtgtacagctgctcgatgttttgtcaaatttgtcagactacgctttaacttttaactcaagtaattgattttaataatattaaattatgtagctaaaatacaaaaatgctattttatgtcaaactatgctttaaatttgtcagactatggttgtcttatgtcaatgtatgctttcagcgaca

SEQ ID NO: 1821 - DNA, 624 bp, Vibrio cholerae strain OYP7G04
atgtacgttcgaaatctccgcaaaccatctgcaacaaaaaatgtgtacaagtttgcgagttctaaaaaccgaagtgtcattttgtgtgaaagttctttagaacgagattgttgttaccatctcgaatactctaaggacgttttttcattccaatcacaacccgaaggcttctattattcttcaggtaacaaacgttgtccctatactcctgattttctcgtgcgaaaccaagatggttcagagtattaccttgaagttaaacctctcgctaaaaccttttctgaagatttcaaacgttccttcgctctaaagcgtattgcagcacagcatcaaggaaaaccattagtattagtcacagataaacagatacgtaatggagtgtatctagaaaaccttaacttaatacatcgatatagtggactagtggatttcagcttgtcctcaacaaaaattgttgaggagttgagtactgcaggaagaatgtgtattcgttcgcttgcggataacctgaaactatcgattggtgaagtgatagcagtcgtctttcgtttaattggattaggcagagttaatgtgcctttagattctgcaattaatgagatgtctgtgatctcggtgaattga

SEQ ID NO: 1822 - DNA, 1908 bp, Vibrio cholerae strain OYP7G04
atgccttttgatgatgagtttgaatccataaatgatgatactcaggccgaatatgattcaacttctgaggctaagctagttcgaaaacaatacctaccacttgattcagtcactattcatgaacgagacctgtcatctttttctgaagaacagaaaaacaaggcattagagcggtacaaacttatttctgctgtcgctaaagagatatccggtggttggacacctaaaaatattaaccctttaattgataaatacggtctcaatttatcgatcaaacggccaagttacaaatcagttattcgttggtataaatccttttgtgggagcgatggaaacattgtgtgtttagtggatcacaatcactcaaaaggaaatagaaccaaacgaattattgatgacgaatccttttttgttgaggccactgaacgttttcttgatgcaaaaagacccaactattcacaagcgtatcagttttactgcgacagaatcgaaattgaaaacagcaatattatctccggtcaaatatccaaagttagttatcaggcgtttaaagaaagattgaaaaaacttcccccttatgaagttgcattaaaacgatttggtcaaaattatgcgaacaagcttttcaattactaccaatcatcggttccgaccacgagaatattggaacgtgtagagctagaccatacaccactcgatttaatccttcttgatgatgacttactgatacctttaggtcgagcctatttgacgttattggtcgatgtgtttagtggctgtattgttggtttccatcttggtttcaatccccctagctatgtatctgttgctaaagcgatcatccattcagtaaaaagcaaagactatgttcatgatttgaatattgagctcactaatgactggttatgccacgggaaaatggaaacactggttgttgataatggagctgagttctggtcaaaaagcttagatcaagcttgcatggaggcaggtatacactatgaatattgtaaagtgggacaaccgtgggaaaagcctcgagttgaaaggaaatttttagaaattattcagggaattgttggatgggttccgggaaaaactttttcgaatatattggaaaaagatcggtatgacccacaaaaagacgccgtaatgcggtttagtagttttgttgaagagctacatcgttggatcattgatgttcataatgcctcccctgactctcggaatacgaagattcccaattaccattggaaaaagagtgaagaagccttaccacccgcagcgcttagtgaccgagatgaaaagcagtttcgaatcattatgggggttattcatgaaggcgttgtgacaactaaaggtataaaatataagcacttaatgtatgacaatgtggcgttagaacaatatcggaagcagtacccacaaacaaaaaagtctcgtaagaaaacaataaaaattgaccccgatgatctgtctagcatattcgtttatctggaggaaatcggtggatacatcgaagttccctgcaaatacgatcctttgggatacacaaagaatctgtcactgagtgagcatgttcgcattactaaaatacatcgtgattttataaaaggccaagtggatgctttatcattagcgaaagctcggcaggcacttcatgaacgtattaaaacggagcaagagcacctttctttaatgtcagttgagagtcgagcgaaaaaagccaaacatggtaagaaaatggcagctctttcaggtatatcaaatgagcagcctatgtccatacagaatgctttagaaaacaaaaacaagccgttagatgacaactttgacgagcctactcctgtagacaatctaaaatcgctctggaataaacgcaaagcgatgaaaaggtctaaagaatga

SEQ ID NO: 1823 - DNA, 987 bp, Vibrio cholerae strain OYP7G04
atgaatctatctgctaaacaagaaattgctgtcgatgaattactaactcaataccacaattcattcgttatttatccagatgtgcaacagatattcgatggccttgattggattgtacgtcgcagtcaatttggaaattttacgccatctatgcttataactggtggcacaggtgcgggcaaaacatcacttattaatcattatgcaaaatatcattttaatgacaatgaagtgttaatcactcgcgtcagaccaagttttatcgaaacacttatctgggcaattgataagttgggtattccttataacactcgttctaaacgttcagaaattggtttacaggattatttcatcaatagtgttaagaaatccaatcttaaactgttggtcatagaagaggctcaagaattgtttgaatgtgcatctcctaaagaaagacaaaaaatacgtgaccgattaaagatgataagtgatgagtgccggttacctatagtctttattgggattcctactgctaaacttattttggaagattcacagtgggatagacgaattatggttaaaagagaactgccttatattcgaataacatcggaatcttcgttagatgtatacatcgatttacttgaagagcttgaaaagcagcttcctatttctgttcaaccggagctttcagagatggatatcgcaatgcgattattatcggctaccaaagggatgctgggagccattaaagagttagtcggctatgcattagagctagcgctgctatcaggtaaatcagcaatcaccaacgacgaatttgcattgggattcgagagaatcaatggccccgatgtaacgaatccgtttacaacagagttggaaaagctattggtaccgcaagttattgagtacgaggggttcatcattgaccccgaaaatggcgaaatcaaatttactaaacaaatatttaaagacataccattagcagctctattgggttag

SEQ ID NO: 1824 - DNA, 1212 bp, Vibrio cholerae strain OYP7G04
gtgaatacagacattcaactttaccctgacgaatcgctcgaaagtttcttgctgcgcttatcgcaagaacaaggctacgagcgattttctcattttgctgaagacatctggttcgacacgttggatcagcatgaagcgattcccggtgctttccccttagagctcaaccgaatcaatatctaccatgcgcaaaccacaagccaaatgcgggtgcgagttcttatccatcttgagaaccaattaaaactcaataactttggtgcactgcgccttgcgttgtcacattcaaaagctcaattttctcccgaatacaaagccgtgcatcggttgggagctgattatccttttgtttttcttgctaaacgcttcacgcctatttgccctttatgtattagtgaggctccatacattcgccagcagtggcaatttctttctcagcaagtttgtgagcgccatggctgtaaattggttcatcactgcccagagtgccaatcgagattggaataccaaaccaccgaaagtattagccaatgcgaatgcggttttgaactccgcaactcaccggtagcagatgcgccagtggctgcgctactggttgcaagatggttgtcaggaaatgactcaaaacctttgggattactgaaggctgaaatgacgccctctgagcgctatggttttttactatggtacgttaatcgttacggtgatattgagaacatcagtttcgagtcatttgttgagtattgctcttgttggccaagagtgctgcaggaagaacttgatgagttggtaaacaaagccgatctcattcgaatcaaagattggaaaaagacgtttttcaatgaagtttttggcgctttacttaaagattgccgccagttaccaagtaggcagttagagcgtaatagcgtgctcacgcaagtgttagcctactttacaaagttaatggcaacactaccttcaagcagcaaagggaatgtaggcgatgtgctgttgagccccttagaagtgtctacattgctttcttgcacaacggatgaggtgtatcggttgtatgagtttggtgagattaaagcagcgattaggccgcggatgcataccaaaattgccagtcatgaatcggcgttcaccctaagaagtgtcatcgaaacaaagctgactcgcatgtgctctgaaaatgacggtttaagcgtgtatctacctgagtggtaa

SEQ ID NO: 1825 - DNA, 2088 bp, Vibrio cholerae strain OYP7G04
atgacgaaattaagtgatctactagcaattgaagacgaagcaataaaacaaactgctctaaaaaagatgtttatgccctatacagaagacgtttgtgttgatgggtatgaacaagaaacgttgacgattttgcttaatctcagttctagtcatcaagctgataggtgctcggattggttggatgtagctcgggctcaaaggtatttaaaagaccgcgaaaacttagatgcctctcttgctgaaatccagtggttccacacacataacctaaagtttccagactgtcgagttaaggaccaacggataattgcgcgacctctttctacagccgaggagtttatttcaagtgcagtattggatcagcgattgggctgggctcataactctgctgtctatcgtcacacattatggttactgaatccttttaaatggcaatcacagccagtgtgtattctttcgcttattcagcagaaaaatccagtttggcttgatctgcttacagaatttggcttggatgtgaagtcacttgctcgcttacaacgtgcaattgaagaacagcttcctgagaatagttttcccgacagtgttagtacttacagtaagcaattacggtttcctttgggggatgattatgtttcgatcacccccgttgtgagtcacgctcttcagtgcgaactagaaataagagcgcgaagtccagaaaacaagttcagttttgtctcttcgtcactgcctaactctgccagtattgggaacctgtgtggcagtttgggtgggtatatgagagtcctaaattacccgctaggtgttaagcaggccaagggtgggacgttaacggaaaaccgtcaaaagagtggtcattactttgatgactatcaggtaactaacgccaaaatttgtcaggtgctaaatcgcctaattgggtctgagccatccaaaacacagcggcaaagagaaagagctcgtaaggttagaagtaagattttacgaaagcaaatagccttatggatgctgccactcattgagttaagagatatcgccgaatctgaacccaatcagcaacaactagagcatgacgacactttagctcaagcctttttgtcgttgccagaatgggagcttggctctttggctggtgagtttaaccgacgcttacatctcgcgtttcaaaataatatctattctgccaagtttgcttatcatcccaaactgatgcaggtagctaaagcacaagtgacatgggtgcttgagcaactaagtaagccaattaacaatcaagatacgttgacgggggagcaatatatctacctgtcgtcaatgagagtgcaagacgcggtagcgatgagtaacccttgtttgtgtggtgtgccgtctttgacggccatttggggattcatgcacgattatcaaaggcaatttaatcaattggttaacaatgattccccagttgagttttcgagtttcgctttttatgttcgaaacgagaatattcaatcaacagcgaagctgacagaaccaaactcagtcgccaaagctagaacggtttctaatgcgaaacgaccaaccattcgcagtgaacgattgtcggatctagaaatagacttagttatcagagttcatagtgaaagccgaatttcagattttagatcagcgcttaaaacggcccttcccgttgctttcgccggaggggcattataccaaccacagctatcgatgcagattgagtggcttagaacatttacaggcaggagtgaacttttccatgttttaaaaggattacctgcatacgggcgatggttatacccaagtgaaaagcaacctactaattttgatgagttagagcggttgctcactcaagacgatgataacttgcccgtttctcttggctaccatttattagagcatccaactaagaggggtaacgcaatcacaggttgtcatgcttatgcggagaatgcgatagggttagctaagcggataaacccgatagaggtccgttttagtggacgagatcactttttaaaccacgccttttggtcgatagaatgcagtagcgaaactattcttataaaaaactatagggattaa

SEQ ID NO: 1826 - DNA, 1032 bp, Vibrio cholerae strain OYP7G04
atggaactttgcactcaattgaactatgttcgatcactttctgctggcaaagcttatttctactatctatccgaaagtggtgagatgtgtccctttaatgtagatagaacccgattgcgcgcaccaaaagggagttattcagaagcatataaggggaacaagttcgtcgacaagaatgttgccccccaagacttggcatattcaaaccctcagttcatcgaagagtgctatgtaaagcccggcgttgatgaaatctattgcgcattttcacttcgaattcgggccaattcgttaaccccagatatctgtagtgatgatgaagtgcgcagtaaactgtctatgtttgctaagatttataaagagctcaacggatacaaagagttagctaatcgttatgcgaagaacatcttgcttggtacttggttatggcgaaatcgtgagtgcagaaatatcactattgaagtgacgaccagtgaattggatacctttgttgtcgaacatgctcaaaaactctcttggtatggtcattgggatggtgattcaacagaatgcttagaaaggcttactgcctatctggagcgagcattgtctgacccaactgaatacttctacatggacgtcaaagcgaaaatgcgggttggctggggagatgaggtttacccaagccaagagtttttggatagtcgagaagatggaatccctactaagcagctagccacagtagagcttttgagcggaaaagaaaccgtcgcgtttcacggacaaaaagttggtgcagcgttgcaatcgattgacgattggtggcatgaagaggctgataagcctttaagagtgaacgaatatggtgcagatcgagaatacgttatagcaagaagacatgtagcatatggaaatgacttctatcaattactcagaaatacagagaactggattgaaagtatgactgcttctgaatccattccgaatgacgtgcactttattatgtctgttttgatcaagggcggattgtttaattgcgccaaggccaattaa

SEQ ID NO: 1827 - DNA, 639 bp, Vibrio cholerae strain OYP7G04
atgtctcaacggtactacttcttgatacgttacacgaatgctaatgccgactatggcttgctagcagggcgttgtatctcacaaatgcacttgtttatggttaatcaccaccaagcaatgaatagagtaggtgtgagttttcctgattggaatgaatcttcagttggtcaaaccattgcctttgtttccgaggacaaagagatgatgattggcctctcttttcagccctatttttcattgatggttaatgaaggtttgtttgagatctccagtgtttatgaggtgccagatacttccgaagaagtaaggtttgttcgtaatcagacgattgggaaaaactttttgggttccaaaaagcgtcgaatcaaacgcagtatggctagggccgagttatttggtattcaacaatcattaccagtaacgaatgaagaccgtgccatcgatagttttcatcaaatccctatttctagcggctcttcacggcaggattatattctgtttattcaaaaggaactcgcagatgagcgtgctgaatctggctttaatagctatggttttgcaaccaatcaagaaaaaagagcgacggtacctgacttacgttttaacccttttgacgaagactcttttttagttcagtag

SEQ ID NO: 1828 - DNA, 28 bp, Vibrio cholerae strain OYP7G04
gtgttctgccgaataggcagccaagaaa

SEQ ID NO: 1829 - DNA, 510 bp, Vibrio cholerae strain OYP7G04
  misc_feature (251)..(260): n is a, c, g, or t
tgtcgctgaaagcataagatgtcctatgcgatcacagaaaatcaaatagttaaaatcaatctaaaaccataaagcgtcctaaactgaaagaataaggtgtcccatgtattgttcgttagaacaagcgatatctgggcatgaaagaaacttacttacgaaaaacgagtgttttcagcattaacattgaacaaatactggcatcttacgtataacaattttttggacataaatcagttaggccttatgctctnnnnnnnnnncgtccttagagtattcgagatggtaacaacaatctcgttctaaagaactttcacacaaaatgacacttcggtttttagaactcgcaaacttgtacacattttttgttgcagatggtttgcggagatttcgaacgtacataacttgtcccttaacgttgtaataaaacaaccaaattaagtttaggacactttatgagttttaaaaggacagcttatgcttttaattggacactttatgctttcagcgaca

SEQ ID NO: 1830 - DNA, 624 bp, Vibrio cholerae strain M1517
atgtttgaccaaactaagaaatcatctcatgtgcacaacatctgtaagttcatgagcttgaagaatgatgctgttgttcgcactctctccattctggagttcgatttctgttttcacctcgaatacaacccaaacatcaaaagttttacctctcaaccttttggtttccactatctattcaataaccgtaagtgtcgatatacccctgactttttagcaataggtcacaatgagcaatcaacattcttcgaggtcaaacactctagccagattcctaaacctgattttagggagcgctttgaagaaaagcagagagtagcgttgagtgagttcaacagacggttagttctcgttactgagaagcaaatcaggatggggccaacgctagataactttaagttgttacaccgctactcaggattgcgaacagtgaccgaatttcaaaagcgagttttggcatttattcaacgtaagcaaatggtgaagttgcaagaggtgtctttgtattttggtctatcagagcaagacacgcttatctctactctaccttggatctcttcggggcacgttaaaacagatctcaacactattggctttggtctagaaacttgcgtttggtgctaa

SEQ ID NO: 1831 - DNA, 1866 bp, Vibrio cholerae strain M1517
atgccaccggactctaatagtatatttgggttctttgatgagtttgaagcgtcagaagaagaatcgcaattgctcccaaaagagctaattctagaacccgttgaaatatcatcgaccatagatagtttgccagcaaaaattcaggaggaggttcttcgccgcataaaagtgattacttttgtggagaagcgcttgaaaggtgggtggacagagaaaaacttgaaccccattttaagtctcgttgaatcagaattacagcttactccccctagttggcggactgtagcaacttggaaaaaatcctacgctgaagcaggtagagaagcttcggcacttattccgaagcatacgtttaagggcaaccgccagaaagaaatggattcgcaatccttgattgacgaggcaattcagaacgtatacctgacacgtgaacgacttagcgttgcagaagcataccgatattataagagtcgagtgattcaaatgaatcgagggattgttgaaggaaaaatcaagccaattgccgaacgttctttttataatagaataaatgagttacccccttatgaagtggcgattgcaagatttggtaaacgatatgcagatcgggagtatcggtcggttggtcagcaggtagttgcaactaaacctatggagtttgttgaaatagaccataccccagttccagtgatcttgattgacgatgaactagatattcctttgggccgcccttatttgacgatgctttatgaccgtttcagtaagtgcattgttggttgcagtatcaactttagagagccaagctttgactctgttagaaaggctctgttgaattcacttttggataaaagctggcttaaagcaaagtatccatcgattgagaatgagtggccttgccacggtaagattgattgcttggtcgtcgataacggtgccgagttttggagtcaaagcttggaagattcgttacggcctttggtgtccgacattcaatacagtcaagcagcgaagccttggcgaaagtcagggatcgaaaagttgttcgatcaaatgaataaagggttagttaacgcgctgcctggaaaaaccttcaccaatcctactcaactacaagattacaatccaaagaaggatgcggtggttagggtatcggtatttcttgaattacttcataaatggattgtcgactattaccacatggcaccagattctagagagcgcgagatcccataccacaagtggcaccaatcgaaatggacgccgtcttactatgatggtgctgagaaggagcaactcagagtagagttaggattgcttagacacaggacgattggagtggccgggatcaggctgcataacttacgctatcagtccgccgagcttattgaataccggaaatattgcacacctaataatggcaaacagctctttgttaagaccaaaacagatccttctgatatcagctacattcatgtttacctagaatcagaaaagaagtacataaaagttccagcagtagacaacagcgggtatacaaacggactttcactttttgaacaccaacgcatacaaaaagtacgcagactgaacaccaaggatcttgctgatgatgaggctcttgcggatacatttctgtatatgaaaaaacgtatccacgaagaaaccgatagattccgtcgtgttaaaagtagcaagcccaaccttcctaaaacaggtaacacgtcgagactagcaaagtttaatgatgtcggatctgagggaccaaactcaatcaacgtgactcctgttaggctcaaatctgaggttgtttccgatgcctcagagtacttagatgacgatgattttgaagatattgaagggtattag

SEQ ID NO: 1832 - DNA, 1098 bp, Vibrio cholerae strain M1517
atgacgatgattttgaagatattgaagggtattagtttgaatttaacgccaaagcagcttgagcagctaaagtcctttgaaacctgctttatcgagtatcccgcgataactgaaatctactccattttcgatcaacttcgtttcaatcactctttaggtggtgaaccagaatctttcttgttaactggtgaggctggaagtggaaagacagctttgatcaacaactacttgtcacgctttcaatcgggttcaacttggggaaagcagccagtattaagcactagagtgccaagtcgtatcaatgaacagaatacgctgacccaatttttggttgatttagattgtaaatcaggaggacgaggaattcggcgccgtaatgaaattgcgcttggcgaagcggttgtaaagcaacttaaacgtaaatctgttgagctgattattgttaatgaaattcaagagcttgttgagttttcaaccgcagaacagagacaagttattgccaacacattcaaatatatgagtgaagaagcaagagtttcttttgtgcttgtgggtatgccttatgctgatgtgatagcgacagaaccacaatggaattcgcggctaagctggagaagaaagatagattatttcaaattgttgaaagcgaatagtcattcgagtaaaacggcatcttatgggtttgacttagaacaaaaaaaacattttgccagatttgtcgcgggtctgagttcaaggatggggtttgatgagccaccagtacttacaaagaatgaactgctatatcctttgtttgcaatgtgccgaggagaatgccgagcgttaaaacacttcttgaaagacgcgttgcttacgagcttcaacgacaatgcggatacgatagacaaagcaatattgtcacgcacttttgcatttaagttcccctacctagataacccgtttgatcgtcctttagagcagcttagtcttcatcaaattgactctggttctgcttaccacttaaatgcaatcaccactgaagataaaatagtagcccctcgttttacggacgccattccgttgagcatgctattgagcaaaaatgggcttaaagcttag

SEQ ID NO: 1833 - DNA, 1212 bp, Vibrio cholerae strain M1517
gtgaaaacggacattcaacattactctgacgaatcgcttgaaagcttcttgttgcgtttatcgcaagagcaaggttacgagcgattttctcatttcgccgaagacatttggttcgacactatggagcagcatgaagcgattgctggtgctttccccttagagctcaaccgaatcaatatttatcacgcccaaaccacaagccaaatgcgggtgcgagttcttatccatcttgagaaccaattaaaactcaataactttggtgtactgcgtctcgcgttgtcacattcaaaagctcaattttctcccgaatacaaagccgttcatcggttgggttctgattatcctttcgtttttcttggtaaacgcttcacgcctatttgccctttatgtattagtgaggctccatacattcgccagcagtggcaatttctttctcagcaagcttgtgagcgccatggttgtaaattggttcatcactgcccagagtgccaatcgagattggaataccaaacaactgagagtattagccaatgcgaatgcggttttgaactccgcaactcaccggtagaagatgcgccagtggctgcgctactggttgctcgatggttgtcaggaaatgactcaaaacctttgggattactgaaggctgaaatgacgctctctgagcgctatggttttttactatggtacgttaatcgttacggtgatattgagaacatcagttttgagtcatttgttgagtattgctcttgttggccaagagtgctgaaggaagaacttgatgagttggtaaacaaagccgatctcattcgaatcaaagattggaaaaagacgtttttcaatgaagtttttggcgctttgcttaaagattgccgccagttaccaagtaggcagttagagtgtaatagcgtgctcactcaagtgttagcctactttacaaagttaatggcagcaataccttcaagcagcaaagggaatgtaggcgatgtgctgttaagccccttagaagcttctacattactttcttgcacaacggatgaggtgtatcggttgtatgagtttggtgagattaaagcagcgattaggccgcggatgcataccaaaattgccagtcatgaatcggcgttcaccctaagaagtgtcatcgaaacaaagctgactcgcatgtgctctgaaaatgacggtttaagcgtgtatctacctgagtggtaa

SEQ ID NO: 1834 - DNA, 2088 bp, Vibrio cholerae strain M1517
atgacgaaattaagtgatctactagcaattgaagacgaagcaataaaacaaactgctctaaaaaagatgtttatgccctatacagaagacgtttgtgttgatgggtatgaacaagaaacgttgacgattttgcttaatctcagttctagtcatcaagctgataggtgctcggattggttggatgtagctcgggctcaaaggtatttaaaagaccgcgaaaacttagatgcctctcttgctgaaatccagtggttccacacacataacctaaagtttccagactgtcgtgttaaggaccaacggataattgcgcgacctctttctacagccgaggagtttatttcaagtgcagtattggatcagcgattgggctgggctcataactctgctgtctatcgtcacacattgtggttactgaatccttttaaatggcaatcacagccagtgtgtattcttttgcttattcagcagaaaaatccagtgtggcttgatctgcttacagaatttggcttggatgtgaagtcacttgctcgcttacaacgtgcaattgaagaacagcttcctgagaatagttttcccgacagtgttagtacttacagtaagcaattacggtttccatggggtgatgattatgtttcgatcacccccgttgtgagtcatgctcttcagtgcgaactagaaataagagcgcgaagtccagaaaacaagttcagttttgtctcttcgtcactgcctaattctgccagtattgggaacctgtgtggcagtttgggtgggtatatgagagtcctaaattacccgctaggtgttaagcaggccaagggtgggacgttaacggaaaaccgtcaaaagagtggtcattactttgatgactatcaggtaactaacgccaaaatttgtcaggtgctaaatcgcctaattgggtctgagccatccaaaacacagcggcaaagagaaagagctcgtaaggttagaagtaagattttacgaaagcaaatagccttatggatgctgccactcattgagttaagagatatcgccgaatctgaacccaatcagcaacaactagagcatgacgacactttagctcaagcctttttgtcgttgccagaatgggagcttggctctttggctggtgagtttaaccgacgcttacatctcgcgtttcaaaataatatctattctgccaagtttgcttatcatcccaaactgatgcaggtagctaaagcacaagtgacatgggtgcttgagcaacttagtaagccaattaacaatcaagatacggtgacgggggagcaatatatctacctgtcgtcaatgagagtgcaagacgcggtagcgatgagtaacccttgtttgtgtggtgtgccgtctttgacggccatttggggattcatgcacgattatcaaaggcaatttaatcaattggttaacaatgattccccagttgagttttctagtttcgctttttatgttcgaaacgagaatattcaatcaacagcgaagctgacagaaccaaactcaatcgccaaagctagaacggtttctaatgcgaaacgaccgaccattcgtagtaaacgattggccgacctagaaatagacttagttatcagagttcatagtgaaagccgaatttcagattttagatcagcgcttaaaacggcccttcccgttgctttcgccggaggggcattataccaaccacagctatcgacgcagattgagtggcttagaacatttacaggcaggagtgaacttttccatgttttaaaaggattacctgcatacgggcgatggttatacccaagtgaaaagcaacctactaattttgatgagttagagcggttgctcactcaagacgatgataacttgctcgtttctcttggttaccatttgttagagcatccaactaagcgggataacgcaatcacaggttgtcatgcttatgcggagaatgcgatagggctagctaagcgaataaacccgatagaggtacgttttagtggacgagatcactttttaaaccacgccttttggtcgatagaatgcagtagcgaaactattcttataaaaaactatagggattaa

SEQ ID NO: 1835 - DNA, 1032 bp, Vibrio cholerae strain M1517
atggaactttgcactcagttgaactatgtccgatcactttctgctggcaaagcttatttctactatctatccgaaagtggggagatgtgtccccttgatgtagatagaacccgattgcgcgcaccaaaagggagttattcagaagcatataaggggaataagttcgtcgacaagaatgttgccccccaagacttggcatattcaaaccctcagttcattgaagagtgctatgtaaagcccggcgttgatgaaatctattgcgcattttcacttcgaattcgagccaattcgttaacaccggatatgtgtagtgatgatgaagtacgcagtaaactgtctatgcttgctaaaatttataaagatctcaacggatacaaagagttagcccatcgttatgcgaagaacatcttgcttggtacttggttatggcgaaatcgtgagtgcagaaatatcactattgaagtgacgaccagtgaattggatacctttgttgtcgaacatgctcaaaaactctcttggtatggtcattgggatggtgattcaacagaatgcttagaaaggcttacagcctatctggagcgagcattgtctgacccaactgaatacttctacatggacgtcaaagcgaaaatgcgggttggctggggagatgaggtttacccaagccaagagtttttggatagtcgagaagatggaatccctactaagcagctagccacagtagagcttttgagcggaaaagaaaccgtcgcgttccacggacaaaaagttggtgcggcgttacaatcgattgatgattggtggaatgaaaacgcagataagccattaagagtgaatgaatatggtgctgaccgagagtacgttatagcaaggcgacacgtaacccatggaaatgacttttaccaattagtcagaaatacagagaattggattgagacaatgacagcttctcgaaccatcccaaatgatgtgcactttattatgtctgttttgatcaagggcggattgtttaattgcgccaaggccaattaa

SEQ ID NO: 1836 - DNA, 630 bp, Vibrio cholerae strain M1517
atgtctcaacggtactacttcttgatacgttacacgaatgctaatgccgactatggcttgctagcagggcgttgtatctcacaaatgcacttgtttatggttaatcaccaccaagcaatgaatagagtaggtgtgagttttcctgattggaatgaatcttcagttggtcaaaccattgcctttgtttccgaggacaaagagatgatgattggactctcttttcagccctatttttcattgatggttaatgaaggtttgtttgagatctccagtgtttatgaggtgccagatacttccgcagaagtaaggtttgttcgtaatcagacgattgggaaaaactttttgggttccaaaaagcgtcgaattaaacgcagtatggctagggccgagttatttggtgttgaacaatcattaccagtaacgaatgaagaccgtgtcatcgatagttttcatcgaatccctatttctagcggctcttcacggcaggattttattctgtttattcaaaaggaactcgcagatgagcgtgctaaatctggctttaatagctatggttttgcaaccaatcaagaaaaaagagcgacggtacctgacttacgttttaacctttttgaagaagattctttttag

SEQ ID NO: 1837 - DNA, 27 bp, Vibrio cholerae strain M1517
gtgttctgccgaataggcagccaagaa

SEQ ID NO: 1838 - DNA, 510 bp, Photobacterium iliopiscarium strain NCIMB 13355
  misc_feature (251)..(260): n is a, c, g, or t
tgatgcttgcagcataagtctgcatagacagagctagctttcaagtagttacgaagaaatttgcagaataagttcgcataagattgcatcaaaagtcagcatatttgagtaggtatctaaattctacgttgtaaagttactacaacaatattctttcaatgatcgatgtcttacatttctactcacagagtacaatttgaggatgtgataggcgtcagtatttcttggacaacatataaaacagagaaagnnnnnnnnnnttgatgtttgggttgtattcgaggtgaaaacagaaatcgaactccagaatggagagagtgcgaacaacagcatcattcttcaagctcatgaacttacagatgttgtgcacatgagatgatttcttagtttggtcaaacatagctaagtcacttttgttgtaaacctacaacaaaacgtagtctatgcagacttatagtgcaaatttgcgaaatattctgcaatttatgcgaacttattttgcaaacatca

SEQ ID NO: 1839 - protein, 229 aa, Vibrio cholerae strain 4874
MSALPSPSTTTLIALESAFVTPARNLTKSRGKNIHRYVSAKMGKRVTVESFLECVACYHFDFEPSIVRFCSQPIRFSYGLNGKTHTYVPDFLVQFDTGEFKLYEVKSDMESSKEEFQCEWEAKVQGAFELGLELELVTEEEILDEVIFSNLKLLHRYASRDNLNHFHQTLLATFKLNGTQTAKSLGHHLGLNGRKILPFLCDLLSRNLLQTSLETPLSLESEFELGCYA

SEQ ID NO: 1840 - protein, 603 aa, Vibrio cholerae strain 4874
MPNKSFSSFHRKSAFQQEKLEPNDRVVDDNDVDEATYQDISAFPDNIATQITFRLSILRYLASKCERIIPKTIEPHRVGLQRLHDRKIPSAISIYRWWLVFRASGCNPVSLAPKNKNKGNSKAKVPTFVDALMEQAVDRVISGRKVRIRSAYRRVRRKLRQHNLNNGTKYKYPTYESLRKRVKKKTPFELLAAKKGERVAKREFRRMGKKILTSYVLERVEIDHTVVDLFAVHEEHRVPLGRPWLTQLVDCYSKAVIGFYLGFEPPSYVSVSLALKNAILRKDDLLSSFDSVENEWLCYGIPDLLVTDNGKEFLSKAFDKACESLLINVHQNRVETPDDKPHVERSYGTINTSLLDDLPGKAFSQYLQREGYDSVGEATLTLDEIKEIYLIWLVDIYHPKSNQRGTNCPNVAWKRGCQEWEPEEFNGSKDELDFKFAIVDQKQLTKAGVTVYKELTYSSERLAEYRGKKGNHKVQFKYNPECMAVIWVLDEDLNEYFTVHAIDYEYASRVSLWQHKYNMKYQAELNSAEYDEDKEIDAEIKIEEIADRSIVKTKKIRARRRGARHQENSARAKSISDAKPVPSQKHEDEIVIVDNEDWDIDYV

SEQ ID NO: 1841 - protein, 329 aa, Vibrio cholerae strain 4874
MNETREARISKAKRAFVSTPSVTKILCYMDRCRDLSDFDSEPTCMMVYGASGVGKTTIIKKYLNQNRRDSEVGGDIIPVLHIELPDNAKPVDAARELLVEMGDPLALYETDLARLTKKLIDLIPVVGVKLIIIDEFQHLVEERSNRVLTQVGNWLKMILNKTKCPIVLFGMPYSKVVLQANSQLHGRFSIQFELRPFSYQGGEGVFKTFLEYLDKALPFEKQAGLANESLQKKLYAFSQGNMRSLRNLIYQASIEAIDNQHATITEEDFVFASKLTSGDKPITWKNPFDEGVKVTEDMLRPPPKDIGWEDYYHNVKPKNQRRKGSNMFE

SEQ ID NO: 1842 - protein, 397 aa, Vibrio cholerae strain 4874
MKTMLLQRPKPFEDESLESYLIRIANRNGYQDVDRFLSALKHYLCDGDSEKFSSFPTDIRRINPYSSKHSSAARSHALHKIGQLTFTESVDLLKLAINRSPLKYSPSVTAVIRGHEVFPRSLLRTNIIPVCPVCLQENGYASYLWHFEGYDYCHIHDLALTYNCQCGKPCDYRVSGLQLVCSSCGTTLTHLLEKPTDRSSDISHWLAGETIKWLPAVPVSYRWGLVHWWMNNKKSKELETESFTIFWKNWPNSFHNLIQETLSYNQTYSLVAPTQWRLKDLLGEILFSSINLPGRNLQYNLILRELFHYLENHLWENNGLIANLRLSAFEVSLILGCSTEEVASMSEQGLLIPIQNRKRYEPMSLTNCIFHFGDVFCIWLAEFQTDEFNRSFYTSRW

SEQ ID NO: 1843 - protein, 642 aa, Vibrio cholerae strain 4874
MTLDELLATTKYEELVSSTKRSFRPLSPLIDITNNPMTALTILVNLTEKGISNKNLLDKERCKEKLRDDKWWAAVLKPAQYRHSHNVKFPDIRSTGTIRTVAPDNLPAYFITSSKLPNVGWTYSKDSSDINRCLFFTSEFLWAGQPCCLARALTDSEHPLWSTLKKLGCYEKNKKLAAKLLSQIPGELIDVDLTGNYLSQVSFPDGRDSYLSFSPVASQAMQSCVYQSLEQHYRQTALMRFDRATNMGLLSASCGGRFRLIETKPYIKDKRHHYISELPNWLTKEAIQSVEQFLRSEQWLVTHNDKPRNMAIVKSSIRSMVNRWLSSRTNTEALSPAELAEQLNNDIASKRIIKRYAYQPKLTRLFIQLIENTGEDNAYKEDRKPTTNSQYLLIPELRISGGSAISSSVSVGLFSMMSLYGFIHAFERNMQLVLTSFTIDSFAICVHDYHLEKRGLTKEPIKKAKVRKDEQEKIAPPAIYDDYQFDSCISLIIKTSESKTIPAEKMVALLPKRFARGAIRLSIDGIQEIGAFPKPLPAIQAIKNPLGSWLSFEPDLSLISTDSIVDIATNHNNLWLTVMGYQYLEPPTTKPSSLRDYPHALVENILGFVKPRTVTKSTNLDDLFWRYQIQPFGVCLLPRSIK

SEQ ID NO: 1844 - protein, 345 aa, Vibrio cholerae strain 4874
MKLPIHLAYERSISPSDVAFLVIWPDGYKEPLPCYSRTILGLNEGSHVGYDGSGAVRNNLKMNTLVDGNIHELDYCSVPYGAKSIECCFSVSFSSELLKPYKCSDAGVKKTLREFVSLYNQHVGLEELIIKYLTNIALGTWLWHNTKRSYCVSIEIRPWPWEGETIIIDDIRKYLKGDRATNDLLNWNKLIEQVKEAFTDPMGLCILEVKANLIKPSMAQLYPSQMFKEAAKKENNRLYQSTIIDGIKSPIMGCYKTGAAIATIDTWYPDAEEPIRVGHYGVDRENSTAYRHPDTGKDFFSILKRIDELVDRLKDAKELSQDELKDMHFLMANLIKGGLFQEKGE

SEQ ID NO: 1845 - protein, 197 aa, Vibrio cholerae strain 4874
MILYYRTVTFLPKIKNNEALVGHCLKVLHGVCTKYTINTIGVSFPEWGEETIGDKISFISPNQLELDFLLQQTYFSEMTALGYLNISQSKSVPEQYNLAVFRRNQKIDQATPNGQRIRAERLAKRAMNRGDSPIRFTPEDLVFEHYHSIPITSTRSGKSFRLNLQYQRLDTVPDGQWAFSSYGLANQELESSPVPVI

SEQ ID NO: 1846 - protein, 228 aa, Photobacterium iliopiscarium strain NCIMB 13355
MQPSPATTYQTDSPLEFAFTQPARKLTKSRGKNIHRYVSIKMNTIISVESTLEFDACFHFDFNKNISRFCSQPIRYSYVIDGIIRTYVPDFLCEFYCGEMVLYEVKAPNAVNSKRFTKEFEAKRQYARKLFDVDLELIEEHDIRHIPLLKNLKRMHRYASHSELTYEQTTILKYLNKHGSTKLETIIDHFSNSKNIIPMIYDLLSKYLINTDLRVLLNNQTELKTTYV

SEQ ID NO: 1847 - protein, 603 aa, Photobacterium iliopiscarium strain NCIMB 13355
MSRTSFSSFHGTPTSDSENASSKLTFIENDDLQDLTSFSKKAQNEAKLRLSILRNILNKSSEINLVLIERLRADLQQQGERSIPSAITIYRWWLTYKKSNFSILSLVPKTKQKGNRNTKVPKTISVYIDQAVEQVISANKINVSTAFRRVRRKVRQYNLTHKTKHTYPSYEAIRKRVKKITPYEKLAASKGDRIAKREFRRMGKKIQTEYLLERVEVDHTWLDLFAVHEEHRVPIGRPYLTQLVDCHSKSVIGFYLGFEPPSYMSVALALKNAIKRKDNLLQNYPSIQNEWLCYGIPDLLVTDNGKEFLSKDFTLACDSLLINIHQNRVETPDNKPHTERQYGTTNTELLNDLPGKTFSNYLQREGYNSSDEASLTLSEIKQIYLTWLVDIFHPRPNSRGTNCPNRVWKHAEKNWPPNEFLGTDEELDFYFTKLDKRMLRKEGIGLATELFYSSERLAEYRGKKGNHKVAIKYNRENMGFIWVLDEDTESYFKVPAIDYEYASTVTLWMHKKNLKIKQELNITEHNLDSEIDAELRIDEIVDQSIQKKKTTITNKRRAARYQENEQMAANARQPKEKKSANNQKTSTKNIEKEDSSGWDIDYV

SEQ ID NO: 1848 - protein, 328 aa, Photobacterium iliopiscarium strain NCIMB 13355
MDDNITRITKAKKAFVSTPDVAAIINNIDRCRRLSKFGAEPSCMMVYGASGVGKTSIIRKYLKANDKDSTARQDIVPVVYIELPENAKPVDAARELLLYLEDPLALYESDLAILTKRIVDLVPTMKIELIIIDEFQHLVEKSSNRILSRVGDWLKMLINKTKCPVILFGMPYSKVVLAANSQLRSRFSIQFELKPFSYINNYGIYAGFLRRLDEALPFDQLSNLASEPIAKKIYAFSQGNMRSLRNLVFHAAVNAIENDNNCISKNDWEFASNLTSGNKLSTWKNPFAQGVKITDRMLQDQPNDLGWEDYMRNNRGKRKPFDESKIFS

SEQ ID NO: 1849 - protein, 392 aa, Photobacterium iliopiscarium strain NCIMB 13355
MFLQRPEPYSDESLESFFIRVANKNGYEDIHRFLIVTKKYLQDENHDRFKAFPTDIKTINPYSSKNNHGSRVAALHKIALMTFNEQPEILSLAINRTSLIYSPSTTALVRGSEVIPRSLLRKNIIPCCPRCLHEEGFGHYLWHFNGYNYCHKHNTPLIYKCACGADYDYRIAGLNGFCRECDTYLNPNQQHPDSAESKTSAWLSGKTIEQLPDLPQSYRWGLIHWWTHLTQKEFDGASFIDFWHRWPESFHHLIQQKIEFNLEHSIIHHDNLKLKDLLGDLFFNCIRLPERNLKYNIVLNELLRFIDDNLWGNNGRLANLKMNAVEVSIFLNCSCDQIVLMVEQRFLKPSRKAKPNKPLSFTDYLFHLGDVYCLWLAEFQTDEFNRTFIISR

SEQ ID NO: 1850 - protein, 636 aa, Photobacterium iliopiscarium strain NCIMB 13355
MSTLAKIINSSSSDINVELKRAFRPLSPNIDITDNEDIALIILTNLAAKVDAKKNLTDRENCKKKLKDNNWWSRCINTMKFRQSHNVKFPEIKATGIIRAHPMGEIPKYLLSSSKLKQKTLAYANDSKDVSVANFLISEFILHGKICCLGVLLTDEQHPLWDRLTKLGCYQKTRKYVAKQLKKIPNSCIEVQLGANSVRQISLPDGNNSYLSLSPVTSQTMQSSCYQSLHKHYWLSKITRYSRASNMGVLPMTCGGTLRMLSHTISFEDVKHCQISPNSSWLTKDSIQAFYDYFDSSNWMMPHIQKQQKLKILKITITEMISRWLALQKNTIQHNQLELVHKLNFDLSNTKSLRQFAYDPKTTRFLFTLIENRSNTQQPNENFDNQYLLLPQISVCGASAMSSSITIGIPSLTAFYGFIHAFERNMQKVFSNLKVDSFAICIHTFHLQKRGMTRESIIKLTSNISSPATHDEWHCDLKFSLALKVNNLTHLNQSEILYALPKRLAGGYARINIDDIKTIQVSSSFKDLVKQIPTFQGQWLSLYKAKIDSFESIIQQIKASQNIIPTCVGYHYLEKPTERTFALRDYKHAFAEPIIGLIKPITIKEDTSLHDLFWDQINKPHYTTIETRNMNNEAPY

SEQ ID NO: 1851 - protein, 349 aa, Photobacterium iliopiscarium strain NCIMB 13355
MKLPISLAYERSIHPSDVCFFTIWPDGNKAPLSFMSRTVLGQMETASLAYDTKGNPKQTATPEVLAQGNPHHMDFCSVPFGAEHIECVFSVSFSSELRKPYKCSEPEVKNTLIELVKLYESKIGWDELAGRFLTNICQGKWLWKNTKKTYQLNIEIKPWPWKNNPVIFEDIRTNYSTYNDCQSDTKWQELKQLIINAFSSKNGLAIFEIKAQLTLPTNAELYPSQAFIEKDKKEKKHQSSRIFQHTSINGQKSPIIGCYKAGAGIFMIDDWYPNAEEPIRIGRFGVHQQDVTCYRPPSTHQDLFSLLEQSEKYIALLKNRKKTPQKTINELHFLMANLIKGGLFQHKGE

SEQ ID NO: 1852 - protein, 199 aa, Photobacterium iliopiscarium strain NCIMB 13355
MDWYYKTIRFIPTNCNNEFLAAKCINILHGFSYRYDTHSIGISFPNWCNETVGDRISFVSIEKMALDYLLTQNYFKEMQDLGYFDISKTLIVPIECNFACFKRYQKIDKSSAAGFHRKIKRLAKRAHNRGEVFDNKKYNIYKQCDIGHYHSLAEESKSKGYGFRLNIQRTNEISINNIPIFSSYGLANTAHALQSVPII

SEQ ID NO: 1853 - protein, 209 aa, Pseudoalteromonas sp. P1-25
MYRRKLKHSRVKNLHKFASQKNKSTCLVESSLEFDACFHFEFSPSIAAFEAQPLGYEYEFDNRICRYTPDFLLTHTDGTQKFIEVKPQSKIADEDFRARFIEKQTIAKQDGRDLILVTDKQIRVYPTLNNLKLLHRYSGFQSLTELQASVLELVKQYGSIKVGQLVNFLKVTAGELLATVLRLLSLGQLFADLTTNEISIETAIWSNNV

SEQ ID NO: 1854 - protein, 607 aa, Pseudoalteromonas sp. P1-25
MFNDGLFDDEFNQPLPKVETKLPQNYAKDLQALPEKIKNTTFAKLKYIQWLEANIQGGWTQKNLEPLLKVMPEVEGEKKPSWRTAARWYSAYTNADKNIMALIPSHQKKGNRERDTATDKFFEKALERYLVKEKPSVASAYKYYADLVIIENDSVVGSVLKPLTYKAFKNRIDNLPQYDVMVSRYGKRLADIAFNKVEGHTRPTRVLEKVEIDHTPLDLILLDDELHIPLGRPTLTMLVDVYSHCIVGFYFSFSEPSYDAVRRAMLNAMKPKSDVAKLYPDTINEWKCAGKIETLVVDNGAEFWSNSLELACEEIGINTQYNPVAKPWLKPFVERMFGTINTELLDPVPGKTFSNILQKHEYNPKKDAIMRFTTFMQLFHKWVVDVYHQDADSRFKYIPSQLWEQGFNTLPPTVLSNADLQQLDVVLSISNHRVLRKGGIRLENLSYDSTELANYRKQFSHKVSQEVLIKLNPDDISYIYVYLDKLEHYIKVPCIDPNGYTQNLSLNQHKINIRIHRDFISGSIDNVGLAKARMFIHNKIQNEFEELKNAPKHSKVKGGKALAKHQNVSSDSQKSIAQSEPLEPKKVTPKEQPTDSWDDFISDLDGF

SEQ ID NO: 1855 - protein, 333 aa, Pseudoalteromonas sp. P1-25
MLTDKQKAKLNEFRDVFIEYPIITTVFNDFDRLRLGKGLAGEKPCMLLNGDTGTGKTALIKQYKERHLPQFINGVMNHPVLVSRIPSNPTLESTLAELLKDLGQVGSTERKLRINGTRLTTSLIKCLKTCGTELIIIDEFQELIEHNQGKKRREIANRLKYINDEAGVSIVLVGMPWAEKIADEPQWSSRLLVRRQLPYFKLSENPKHFVQLIIGLANRMPFTEKPKLSEQATVFALFSLSKGCFRTLKYFLDDAVLYALMDNAKTLTTKHLVKAFGVLFPDVPNLFTLPVAEITASEVERYSLYKLESAQDEDPFIATKFTDQMPISQLLRK

SEQ ID NO: 1856 - protein, 391 aa, Pseudoalteromonas sp. P1-25
MHFLVQTKLYPDEALESYLLRLARDNSYDGYSELADILWQWLVEQDHDLEGALPLELGKVDVYHARQASSFRIRALKLVAQLADVNAGNILALAWRRSNFKFGNLVAVSRNEQTIPLELLRTDNIPVCIECLFESSYVPFHWHLKPYKTCHKHKSQLTTHCKECHNLIDYRASEEFLECSCGCKLTNSEQLNDADFKIAFALASSNSHKIVGLISWFAKVKQLDVSDADFNRTFVDYFSTWPESLTTELDLLTNNARLKQLNPFNKTKFNSVYGNVIRDGQIAATSNRKNKVLDELIKYFVELVDSNPKTKHPNIADLLLCTFDTAVLLNTTTEQVYRLHQEGFLNCAYPQKKHEQLRADSHVFYLRQVIELQQAFAAETPQTKKQFIAPW

SEQ ID NO: 1857 - protein, 683 aa, Pseudoalteromonas sp. P1-25
MNLQDAFAIESLKEKTTALRKLFTPYMSHVAVDGFEEQALTVLINLVYKRSEIDDLTSTRTAKSVLRDEVLLSKCINEVKWFHTHNLKYPDIRVSHQRLISKVVSEDIAGICSRSLPLSFGWSHNSAEINHAKLFLTSFTWQGEVTCLANLLINEEPVWINLIRTYGFTKKAVLGIAGKIKQLLPVAELPLEVSSFSPQLQMPFQQSYLAVTPVVSHAMLAKIQQLTTDRKLNFGLVEHSRPANVGDLASSVGGNIRVLRYFPKTYSKAVNCSEVFNNDSEKAFKIRALLNSQFQQALLVLVGIKQFNTLRQKRLARVAAIRQVRVSLQLWLDNILEAKNNAQGQAYPEWAKHYLDQSITNCISQFSNVLNESLGNLSKLKRFAYHPNLMGVFKTQLNYVFTHCIPDEETLNDEQIVYVHCQDMRVFDAEAMANPYIQGMPSLTALNGLAHNFERKLKNFIDPSIKCIGSAINIESYQLHTGKPLPEPSKLKQVAGRSHVIRSGIIDKPKCDITLDLVFRLFVPNIKLLDKLNSQLVKPALPSMFAGGTMHPPSLYQNIDWCHLHTKPSELFKNIKAKSLNGSWLYPSKKVVKSFEQLIDALNGNFNLRPAAIGFAALEEPIKRDVALHEYHCYAEPVIGLLECVSNTSVKYAGAKQFFHDAFWVMDVQKESMLMKKSKFEYE

SEQ ID NO: 1858 - protein, 342 aa, Pseudoalteromonas sp. P1-25
MQLPRHLSYTRSLSPSKAVFFYKTSESDFEPLQIEQNKLVGQKSGFGDAYQKQNVAKNLAPQDLAFGNPQTIDVCYVPPAVNELFCRFSLRVEANSNEPHVCDDPKVIYWLKRFFETYKKHNGLNEVATRYAKNILMGNWLWRNRQSPNVDIEILTEHAAPIIVEGAQKLKWQGNWQNNQTALITLSEAIQEGLSNPQNYCYLDITAKIKNAFSQEVHPSQKFVDNVEQGMSSKQLAYTQVGDKKAASLNSQKVGAAIQTIDDWYEGGYKPLRTHEYGADKQILVAHRTPKSHSDFYSLLPRIALHIKHMEKHGLEQSEESNAVHFIAAVLIKGGLFQRSKA

SEQ ID NO: 1859 - protein, 199 aa, Pseudoalteromonas sp. P1-25
MKRYYFTITYLPKNCDVSLLAGRCIGILHGFMSSREISNIGVCFPKWNEQEIGNELAFVSTDKKQLTNLSQQSYFEMMAQDKLFGLSKILEVPTNQNEVMFIRNQSVAKAFVGEKQRRLKRAKKRAEARGEVYNPEYQFEAKDIGHFHSIPVSSKANGQSYVLHIQKIENTNATENQFNNYGFATNQTFQGTVPSLNTQ

SEQ ID NO: 1860 - protein, 210 aa, Pseudoalteromonas ruthenica strain S3245
MYRRNPKSSRVKHQFKFASQKSKNTCFAESALEFDACFHFEYSSAIVAFETQPLGFKYDFEGRTCPYTPDFLLTHSDGTQKYIEIKPVKELAKDEFRQRFEQKQLASKQLGIELILVTDKQIRVFPVLDNLKLLHRYSGFQVLTELHTVVVGLVKSTGLVKVAQLVNYLKVSAGEVLSIVARLLCIGQLATDLTTDALSLDSVIWASDEQ

SEQ ID NO: 1861 - protein, 612 aa, Pseudoalteromonas ruthenica strain S3245
MNSKSLGLFDDEFQHPIPQVEAPKSTKAEKDLSAYPQEIQQTTYARLKYIRWLKERIVGGWTEKNLAPLINEMPKVEGADKPNWRTAARWFKSYSESDESIFALIPKHQKKGKRTQRTDTDKFFEKALERFLVKERPSVSSAYQYYKDLVVIENEKVIGEDLRPLTYKAFKNRIDKLPHYEVLRARYGKRIADLAYNKVESHKRPTRVLERVEVDHTPLDLILLDDELQIPLGRPTLTILIDVYSHCIVGFYLGFNDPSYDAIRRAMLNAMKPKNWIKEQYPDITHDWHCCGKIETLVVDNGVEFWSNSFESACAQIGISLQYNPVGKPWLKPFVERIFGVINTQLLDPIPGKTFSNMMKKEGYDPNKDAIMRFSAFMEVFHHWIIDVYHQEADSRFSYIPALEWDRGYEQLPPAPLSSDDIQRLEIVLGISTWRHIRKGGIHFENLRYDSNELADYRKRFSPKASVKLMLKVNPEDLSRVYAFLPELDHYIEVLCIDPNGYTAGLSLHQHKVNVRLQRDFIGSHMDVAALARARMLIHEKIQNEVELLANSTKKPKARGGKALAKYQNVASDNLVSVKPSSPTKKPPEKVETEEAQNKGDWDDFVSDLEGF

SEQ ID NO: 1862 - protein, 333 aa, Pseudoalteromonas ruthenica strain S3245
MLSEIQTQRLNEFIDVFIEYPLMTTILNDFERLRTGQKLAGEKQCMLLTGDTGCGKSSVINHYKNKHPACHIDGVYHHPVLVSRIPSRPTLESTIAQLLSDLGQVGAAKRKLKRNDANLTDSLITNLKSCGTELIIINEFQELVESNQGKKRNEIANRLKYLNEEAGIPIVLVGMPWAEQIAEEPQWSSRLMVRRFIPYFKLSKDLTLFVRVLMGLATRMPFRDKPRLQEQDIVYALFAVSKGCFRTLKYFLNEAVKQALMYGSETLTKQHLSAAFEVFYPGIEDPFKLSVDEITACEVESYSVYHTDSSSDNEAHNRTRFTEKMPINQLLKK

SEQ ID NO: 1863 - protein, 392 aa, Pseudoalteromonas ruthenica strain S3245
MHFLVQTKPFRDETLESYLLRLTRDNAYTDYHELADIIWQRLVECDHELEGAFPLELKTANLYHASQSSCFRVRAFKLVAQWAALEPLELIRLSWLRSNTQFGHLSALIRDQLLIPRTLLRESHIPVCLSCLKEEGYIPYYWHLKPYKACHKHKMQLQSHCAECGELIDYRASERFSQCNCGAKLKTTAPASEADIAVSEGLSGADAHDLVGKLTWFAYQYGQDQEHASFNEAFIAYFKYWPDNFFAELDEKASRAREKQLRPFNHTKFDSVFGDVIKVSKVAGPNVLRTNIIVDSLLEFFSDLVEKNPKQKHPNIADLLVNSSDAATLIGTTLEQVFRLYQEGQLTCCERLNKNERLQPDRCVFYLRQVVELAQSQGRYVGDFKNQLITPW

SEQ ID NO: 1864 - protein, 693 aa, Pseudoalteromonas ruthenica strain S3245
MDLAEALAIKSVREKSDALRKLFAPYASSVAVDGYEQQVATVLINLVYKRNEQIDLASIKAAKDVLKDTELMAKCISEVKWFHTHNLKYPDIRVSHQRLIAQVIDKDIPAITSASLPKLLGWSHNSAEINHAKLFLTSFKWQGEVNNLAGVLVDEHPAWIEAMRNLGLTKKSVMALATHIRELLPATDLPGEVSEFTPQLMMPYGKDYLSVSPVLSHAMLVRVQQLARDKVVNWGVVEHTRPANVGDLPSSLGGNVRVLRYFPATSLKGSLGEYIENDPNERLFKHKVLTSKSFKTSLIILTGKSVYNTLRQKRLARIAAIRQLRSTLMHWLDKIIEFQNNGNHNLVPEPMKSFIENLKPNLNGVVCELSGLLNEQLSSHHSLKKFAYHPDLMSVLKRQLQYVLTHGETVDETLVDSQILYVHCKGLRIFDAEGMPNPYLQGIPSLTALAGVAHKFQRKLQSIVDPSIECIGSAIFVHSYQLHTGKPLPEQNQLKTNQGITSAKRPGIVDKPKCDMTIDLVFRLFVPHESTRTQLTDNMFKAAFPTSFAGGTMHPPSLYETVEWCQAFTSPTQLFGELSLLPSRGCWLYPSKHQVRTFEDMVELLDADPNQRPAGLGFASLEQPTQRKEALGSKHCYVEPAIGLLECVNPITTRMGGAKAFFHNAFWVIGVEKTSMLMKKAKFEYTQCDSRDT

SEQ ID NO: 1865 - protein, 342 aa, Pseudoalteromonas ruthenica strain S3245
MRLPRHLSYTRSLSPGKAVFFYQTPESDFEPLQIEQNKLIGQKSGFTDAYQKLGEPKSLAPQDLAFGNPQTIDVCYVPPTVNEIFCRFSLRVEANSVEPYVCDDRKVSYWLKRFVETYKEHGGFKELASRYAKNILMGNWLWRNKQSPGFDVEVLTEHSEPIVIEGAQRLKWNGVWGNDEAALATLTEAIENGLANPQAYCYLDITSRIKTAFCQEIHPSQKFVDNVEQGMSSKQLAYTQVDGKQVASLNAQKVGAAIQTIDDWYTEDLKRLRIHEYGADKQVLVAHRTPKNGLDFYSLLPKVAVYIRHMERDGLEDDEESKHIHYLASILLKGGLFQRSKG

SEQ ID NO: 1866 - protein, 201 aa, Pseudoalteromonas ruthenica strain S3245
MKRSYFTVTYLPINCDYSLLAGRCIGILHGYLSRFELDGIGVSFPKWNEETVGNQIAFVSESESHLQTLRQQNYFQMMSHDGLFKLSVTRTVPEQVDEIQFVRNQSISKAFVGERRRRMVRAKLRAEARGEEYNPIYEFEPTEIEHFHSIPITSKSNNNEFVLHIQRRECSGTAGGFNKYGFATNEHHLGTVPSLSGLLIS

SEQ ID NO: 1867 - protein, 209 aa, Photobacterium ganghwense strain JCM 12487
MYRRKLKHSRVKNLFKFVSAKMNQAMTVESYLEFDTCFHLEYSSSIISFAAQPEGFIYRIDGRDCSYTPDFQILENEEVKWIEVKPFVKTQRPDFLQRFKVKQEKALALGVPLILVTEKQIRVNPVLNNLKILHRYSGFQSLTDLHIRLLSLVKTVGKISVSDAACRLGIDQGMMVKSAFSLVSSGMLTADLVHDELGLHSIVWSEHNG

SEQ ID NO: 1868 - protein, 622 aa, Photobacterium ganghwense strain JCM 12487
MAKDISTGLFQDEMAVASSSEPVEALPSSTDDFFERDLASYPDEIQIEVRRRIEYLQWIEKHLVGGWTQKNLDPLIEKAAREIDFPPPKWRALAKWWSVYSSSGKMLASLVPKLHRKGNRNLKITNELSFFDRAVERYLVPERPSISAVYQYYTDLIRIENQHLVGEKVQALSYKGFYNRIKKLPAYEVAVARHGKYLADMEFNKIDAHQPPSRVLEKVEIDHSPLDLILLDDELNIPLGRPYLTLLIDQYSKSIMGFHLGFKEPSYYSVMKAILNAIKPKDDIAERFPGVVHDWYCQGKMESLVVDNGAEFWSKSLEQSCLEVGIHIQYNPVRKPWLKPLVERIFRTIGSKLLVTIPGKTFSNILAREEYDPRKDAVMHFSVFNELFHKWIIDVYHYESDSRKRAIPYVKWQEGVVVMPPISYEPEDLEKLSVVLGIKELRKHRRGGIHLHGLRYDSEELADYRRMYSRDIDVLTKTNPDDISSIYVYLEHKQQYLKVPCIDPIGYTKSLSLTQHHINQRLHRDFIDSQLDLEGLARVRMYIHDRIEQEADEIKNLNRGRPRRTTKGMARLAKHNGVASDVQTSCVPETLPELSMPDKGKESKQLPDSDEWDDFISDLEPY

SEQ ID NO: 1869 - protein, 338 aa, Photobacterium ganghwense strain JCM 12487
MDSLSPEDEAKYQAFVDIFVEQPIATMVMADFDRLRYNRQFGGDQQCMLLTGDTGSGKSFLIKEYCRRLAQTNPMKQALVLSSRIPSKPTLESTIIELLKDFGHFGATYRKGKSKDQSLTVSLIKCLKASCVELIIINEFQELVEFKTGRALNEIATRLKHISEEATVPIVLVGMPWAAKIANEPQWASRLLIRRELPYFKLSEEPEHFIRFIKGLAARMPFTELPKLDNKQTILALFSASNGQTRRLKQLLNEAVKLALVQNAVTLTNEHLADVFRMIFPAIPNPFLASIEQIEGQEVSLPSHYDSGADNEFEAIIPTQYTDRLPLSQLLRKSRKTK

SEQ ID NO: 1870 - protein, 405 aa, Photobacterium ganghwense strain JCM 12487
MFLIHPEKHYQDESLESFLIRLCECNGFESFRLLSGALWEWLVDNDHQAAGALSRQLCEINLYHAKHSSGFRVRAFELLDSLFKGNARPLMQHALLHSAVTFSPNLTSVFRAGIHIPRCFLRQSYTPVCPACLTEAPYIRQYWHLKPYQSCHRHGVAMLFHCPSCSAVLNYQDTEQIETCSCGFDLRDAGTNVASSEQIAISQLVVEGEMQNALSISHWLGALLWFYRYKQSQLSLNVVKEPEFGRAVEYFSQWPNAFVRDLHELATQAEMKLVRGFNHTRFSEVFGDLLSSSRKLPSSDTQQNFILKAVIDFLQQLVRDNPKAKETNIADVKLTVVEAAALLTTSTEQVYRLYEEGYLQSSVRFKLHSKLSPNDAVFFLRHVVELRMAGMASDYSANDVYLPSW

SEQ ID NO: 1871 - protein, 691 aa, Photobacterium ganghwense strain JCM 12487
MVRSMHLSELLLVQDTEERNQLLRKALAPYTCLVDVTGYERQLLMIAINITVPRKDVDDVLDKKLAKSLLTNTKHLQRCIDEVQWFHTHNVKYPDSRVKGQRIISLKQDEVDGVLCSANLPSSLGWAHNSSQVNPAKFFSIRFIWQGRAMSLLETVIDAPSEWKVAFRSLGIIKKQLSEFREIFSTYYTSSQIPSEVSDYSTQIRVPYQGYYCALTPVISHSVQSKIQKMAFGRKVKSSNVEHHHPASVGSLVAALGGNIRVLDYPPNVRQKTSEAFSLYRAVSEKEVFDHSIIKEKRFLDALSRIAGENPTPTLRQRRQLRVSALRFVRKQLALWLAPMMEWRDSIGGESRHSPIETLEEQLLYLPIAHLPDVLSDLNTRFHQALQYHRRGARYAYHPEVLFPIKQQLKWLLRYMANQQDALITPEPNCVYLHLQQLVVHDASLLSNPYVSGIPALTALGGLMHNYQRRLSALMECECLIQRGAWFIAHYHQQKIKKLPEPDKVRYLKKRSDVQRPGITDGKYGDLTMNLVLELQLPESVSIPELSLLQAAFPSRFAGGTLHPPSLFEQTDWLSVYSNQSELFSVLARLPRSGCWVYPDDKGVSSFDELASRLDNDPDLKPVGLGFIPLEEPHCRVGSIAPYHCYVEPCIGVVRCMNPINVRLSGSQQFYQSAFWHFDIANDAMLMKKAT

SEQ ID NO: 1872 - protein, 344 aa, Photobacterium ganghwense strain JCM 12487
MQICRHLNYVRSLSPGKAVFYYQTPESDFVPIQVETNRIRAAKSGFTEAYDKNQNLKNVAPQDLAYSNPQCIDACYVPPNISEIHCRFSLRVEANSLQPDSCEDQKVRRYLIQLASIYAQVGGYQELAKRYCKNILMGTWLWRNNHTLGTRIDVITSSGRCYAIDDARYLDWIDWPEEEQVMLNDLASEMAAALCEPKQFWFADIKATLKTGFCQELHPSQKFTDSHEQGESSKQYATVECPNGIQAACFHAEKVGAALHLIDDWWDEVADKRLRTHEYGADRDYLIARRHPMKKQDFYSLLTLTAVFIRQLRNVRDKGGEIPPQVHYLMAVLCKAGMFQRGKS

SEQ ID NO: 1873 - protein, 207 aa, Photobacterium ganghwense strain JCM 12487
MANRFYFLIRYMPEDVDEGLLAGRCISILHGVLSSDQNDIDGGIGVVFPQWSCTSLGRSIAFVSDNQRHLEQLSQQHYFAVMKGDNLFDISHIQAVPSGLSEIRFKRNQGIAKCFAGEKRRRLARAKRRAEARGEVFNPKHGMSDREVSLFHKAVMTSKSTGQKYLLHIQRETVTGSSVSQYSQYGLATNIECMGTVPDLSPIIPFF

SEQ ID NO: 1874 - protein, 209 aa, Shewanella sp. UCD-KL21
MYIRNLRKPSPNKNVFKFASAKVSETIMCESTLEFDACFHHEYNETIETFGSQPKGFYYCFEGKRLPYTPDALLHYIDGTTKFHEYKPYSKTFDPIFRAKFVAKKEAAQALGTELILVTDKQIRVNPILNNLKLLHRYSGIYGVTDIQRELLQLIRHSGKIQLDDVADEYELSVGETRSFLYSLINKGLLEADLTQDDLSCNPFVWCNA

SEQ ID NO: 1875 - protein, 617 aa, Shewanella sp. UCD-KL21
MIEFKDEFTESTSVKKPDTPGQYIKLDDAEILKRDLDTFPDFLKEKAFDKYKLISFIEQENSGGWTQKKLDPILDKLFEGNRDKRPNWRTVVRWRKSYIDSNGDLASLVVKRHKMGNRKKRVEGDEVFFERALSRFLDAKRPKVTTAYQYYKDAITIENETIVDGEIPIISYTAFNQRIKSLPPYPIAVARHGKFKADQWFAYCSSHIPPTRILERVEIDHTPLDLILLDDELQLPLGRPYLTLIVDVFSNCVLGFHLSYKAPSYVSAAKAIVHAIKPKTLGIVGIELQNDWPCYGKFETLVVDNGAEFWSKSLDHACKEAGINIQYNPVRKPWLKPFVERFFGMINQYFLTELPGKTFSNILEKEDYKPEKDAIMRFSVFVEEFHRWIVDIYHQDSDSRDTRIPIKQWQHGFDVYPPLQMSVEDEKRFNVLMGITDERTLTRNGFKFEELMYDSTALADYRKHYPQTKDTIKKLIKIDPDDLSNIHVYLEELEGYLKVPCTDTTGYANGLSLHEHKVIKKINREIIRESKDNLGLAKARMAIHARVQQEQELFNESKTKAKISAVKKQAQLADISNTGQGTIRLENSDTLSDITNKPESNISDILDNWDDNIEGFE

SEQ ID NO: 1876 - protein, 343 aa, Shewanella sp. UCD-KL21
MNTLTAHQMEQLGRFNDCFVMHPQAKVIFNDFDDLRLNRNFQSDQQCMLLTGDTGVGKSHLINNYKKRVLASQTYSRTSMPVLVTRISSHKGLDATLRQMLTDLESFGSQQRKGQNYKIDLKTQLVKNLVRANVELLIFNEFQELIEFKTPKERQTIANELKFISEEARVPIVLVGMPWTEQIAEEPQWSSRLIRRRKLEYFSLQKDSKYYRQYLIGLAKHMPFDEPPKIEDKHIAIPLFAACRGESRVLNHLLSETLKLVMVNGDRSLDIRHLAQTYRKLYESQESEAASVFFNPFLEPLDKVLISEVVKPSRYNPNAMTPDEMLIKREFSAPSTLAQLLSK

SEQ ID NO: 1877 - protein, 411 aa, Shewanella sp. UCD-KL21
MAFLFSPKARSFSDESLESYLLRVVAENFFDSYQQLSLAIREELHELDFEAHGAFPVELKRLNVYHAKHNSHFRMRALGLLESLLDLPPHELQKLALLRSNKRFVGGMSAVHRNGVDIPLSFIRCADEDGIESLPICPQCLKEEPYIRQAWHIKPIEVCAKHECELIHHCPDCQQPISYIENESITHCSCGFEFATASSEKADSQAVVLSRSLFDGDALSNNPLLFMGTSVTHRFAALLWYLKRHVQNIECKLDESVNYFEAWPENFYQELDELLAGAELKLIDLFNRTSLSFIFGELILQSQCLLPEDKTPHFIDMGLMEYLGKLVESHPKSKKPNVADMLVSVTETAVLLSTSHEQVYRLYQDGVLTAGFKQKIRTRIDPHIGVFYLRQVIEYKTSFGNDKQGMYLSAW

SEQ ID NO: 1878 - protein, 699 aa, Shewanella sp. UCD-KL21
MVDKLKFHELLDIDDISERNIALRRAFTGYTVPMDVTGNEASALTILLNLTYPRKRVDDLLDKRLAKQTLNTDAHLDASIDEVQWLHTHNLKYPDIRVSKQRLITASPLSHSHILSSANCISTLGWSHDSAKVNLAKLFSCHFNWQDRVCCLATLLSDPPKIWKEAFQALGMLVKDFMNLCGRIKASLPSYESPSRVDKYSIQVRLPYRDGYLAITPVVSHALQAEIQQAAMAKQCRYTNFEFTRPAAVSELSASLGGNVKALNYPPRIGNAVHGLSDSWLLKFQAGQTVLNQGALSQPRFKRALEGLLSNGFELALKQRRLHKVASMRQIRATLTEWLSPLLEWRLEVEENKNNVSELACIHGSFEYQFLTAQKENLVGLLNPMFSLLNTILSNSNTLQKYAFHQRLMRPLKCSLKWLLDNLSKESNAIDSDEDNQQRYLYLKGIRVFDAQALSNPYCAGLPSLTAVWGMVHNYQRRLNKRLGTQLRLTSFSWFIRQYSSVAGKKLPEYGMQGQKENQFRRAGIVDNKHCDLVFDLVVHIDGYEEDLDAIDNSTDAIKASFPATFAGGVMHPPEIGSVDEWCELYPSETSLYSKLRRLPASGKWVMPTRYQMDSLDGLLQLLKLNVALCPVMSGYLMLGPPESRKNSLEPLHCYAEPAIGVVECATAIDIRLQGMSNFFRRAFWMLDIKETSMLMKRI

SEQ ID NO: 1879 - protein, 365 aa, Shewanella sp. UCD-KL21
MELCNVLKYDRSLYPGKAVFFYKTAESDFVPLEAEINRIRGQKAGFTEAFTPQFKSKNLAPQDLAHCNPLILEECYVPPNVEYIYCRFSLRVQANSLKPAGCSEPTVFALLEEFAAIFKACGGYKELATRYCKNVLLGTWLWRNQNTGNSQIDIKTSAGNCYQIANTRQLAWDSRWPADAQQVLEELSDEVHQALTDPTVFWHANITAKIETAFCQEIYPSQSFGEKAAQGEASKQFAKVKCVDGRYAVSFNSVKIGAALQLIDDWWDVDDSKRLRIHEYGADKELGVARRAPESKQSFYSLFINTELYLAELNQQLAEDEYSISPNIYYLFAVLIKGGMFQKKAEAKSKSKAETSTAKITPAKA

SEQ ID NO: 1880 - protein, 199 aa, Shewanella sp. UCD-KL21
MHRYYFMVRFLPEQANLALLMGRCISIMHGFICKHDIQGLGVSFPAWSDASIGNMIAFVHTDIAALNELKLQGYFQDMQECGVFKVDNVEAVPDDCVEVRFKRNQGIAKMFVGEARRRLKRLEKRALARGEVFNPNKNDEPRELDCFHCIAIGSTSTEQDFLLHVQKEIVQKYEEPEFNQYGLATNKLLRGTVPEFSEF

SEQ ID NO: 1881 - protein, 207 aa, Vibrio cholerae strain OYP7G04
MYVRNLRKPSATKNVYKFASSKNRSVILCESSLERDCCYHLEYSKDVFSFQSQPEGFYYSSGNKRCPYTPDFLVRNQDGSEYYLEVKPLAKTFSEDFKRSFALKRIAAQHQGKPLVLVTDKQIRNGVYLENLNLIHRYSGLVDFSLSSTKIVEELSTAGRMCIRSLADNLKLSIGEVIAVVFRLIGLGRVNVPLDSAINEMSVISVN

SEQ ID NO: 1882 - protein, 635 aa, Vibrio cholerae strain OYP7G04
MPFDDEFESINDDTQAEYDSTSEAKLVRKQYLPLDSVTIHERDLSSFSEEQKNKALERYKLISAVAKEISGGWTPKNINPLIDKYGLNLSIKRPSYKSVIRWYKSFCGSDGNIVCLVDHNHSKGNRTKRIIDDESFFVEATERFLDAKRPNYSQAYQFYCDRIEIENSNIISGQISKVSYQAFKERLKKLPPYEVALKRFGQNYANKLFNYYQSSVPTTRILERVELDHTPLDLILLDDDLLIPLGRAYLTLLVDVFSGCIVGFHLGFNPPSYVSVAKAIIHSVKSKDYVHDLNIELTNDWLCHGKMETLVVDNGAEFWSKSLDQACMEAGIHYEYCKVGQPWEKPRVERKFLEIIQGIVGWVPGKTFSNILEKDRYDPQKDAVMRFSSFVEELHRWIIDVHNASPDSRNTKIPNYHWKKSEEALPPAALSDRDEKQFRIIMGVIHEGVVTTKGIKYKHLMYDNVALEQYRKQYPQTKKSRKKTIKIDPDDLSSIFVYLEEIGGYIEVPCKYDPLGYTKNLSLSEHVRITKIHRDFIKGQVDALSLAKARQALHERIKTEQEHLSLMSVESRAKKAKHGKKMAALSGISNEQPMSIQNALENKNKPLDDNFDEPTPVDNLKSLWNKRKAMKRSKE

SEQ ID NO: 1883 - protein, 328 aa, Vibrio cholerae strain OYP7G04
MNLSAKQEIAVDELLTQYHNSFVIYPDVQQIFDGLDWIVRRSQFGNFTPSMLITGGTGAGKTSLINHYAKYHFNDNEVLITRVRPSFIETLIWAIDKLGIPYNTRSKRSEIGLQDYFINSVKKSNLKLLVIEEAQELFECASPKERQKIRDRLKMISDECRLPIVFIGIPTAKLILEDSQWDRRIMVKRELPYIRITSESSLDVYIDLLEELEKQLPISVQPELSEMDIAMRLLSATKGMLGAIKELVGYALELALLSGKSAITNDEFALGFERINGPDVTNPFTTELEKLLVPQVIEYEGFIIDPENGEIKFTKQIFKDIPLAALLG

SEQ ID NO: 1884 - protein, 403 aa, Vibrio cholerae strain OYP7G04
MNTDIQLYPDESLESFLLRLSQEQGYERFSHFAEDIWFDTLDQHEAIPGAFPLELNRINIYHAQTTSQMRVRVLIHLENQLKLNNFGALRLALSHSKAQFSPEYKAVHRLGADYPFVFLAKRFTPICPLCISEAPYIRQQWQFLSQQVCERHGCKLVHHCPECQSRLEYQTTESISQCECGFELRNSPVADAPVAALLVARWLSGNDSKPLGLLKAEMTPSERYGFLLWYVNRYGDIENISFESFVEYCSCWPRVLQEELDELVNKADLIRIKDWKKTFFNEVFGALLKDCRQLPSRQLERNSVLTQVLAYFTKLMATLPSSSKGNVGDVLLSPLEVSTLLSCTTDEVYRLYEFGEIKAAIRPRMHTKIASHESAFTLRSVIETKLTRMCSENDGLSVYLPEW

SEQ ID NO: 1885 - protein, 695 aa, Vibrio cholerae strain OYP7G04
MTKLSDLLAIEDEAIKQTALKKMFMPYTEDVCVDGYEQETLTILLNLSSSHQADRCSDWLDVARAQRYLKDRENLDASLAEIQWFHTHNLKFPDCRVKDQRIIARPLSTAEEFISSAVLDQRLGWAHNSAVYRHTLWLLNPFKWQSQPVCILSLIQQKNPVWLDLLTEFGLDVKSLARLQRAIEEQLPENSFPDSVSTYSKQLRFPLGDDYVSITPVVSHALQCELEIRARSPENKFSFVSSSLPNSASIGNLCGSLGGYMRVLNYPLGVKQAKGGTLTENRQKSGHYFDDYQVTNAKICQVLNRLIGSEPSKTQRQRERARKVRSKILRKQIALWMLPLIELRDIAESEPNQQQLEHDDTLAQAFLSLPEWELGSLAGEFNRRLHLAFQNNIYSAKFAYHPKLMQVAKAQVTWVLEQLSKPINNQDTLTGEQYIYLSSMRVQDAVAMSNPCLCGVPSLTAIWGFMHDYQRQFNQLVNNDSPVEFSSFAFYVRNENIQSTAKLTEPNSVAKARTVSNAKRPTIRSERLSDLEIDLVIRVHSESRISDFRSALKTALPVAFAGGALYQPQLSMQIEWLRTFTGRSELFHVLKGLPAYGRWLYPSEKQPTNFDELERLLTQDDDNLPVSLGYHLLEHPTKRGNAITGCHAYAENAIGLAKRINPIEVRFSGRDHFLNHAFWSIECSSETILIKNYRD

SEQ ID NO: 1886 - protein, 343 aa, Vibrio cholerae strain OYP7G04
MELCTQLNYVRSLSAGKAYFYYLSESGEMCPFNVDRTRLRAPKGSYSEAYKGNKFVDKNVAPQDLAYSNPQFIEECYVKPGVDEIYCAFSLRIRANSLTPDICSDDEVRSKLSMFAKIYKELNGYKELANRYAKNILLGTWLWRNRECRNITIEVTTSELDTFVVEHAQKLSWYGHWDGDSTECLERLTAYLERALSDPTEYFYMDVKAKMRVGWGDEVYPSQEFLDSREDGIPTKQLATVELLSGKETVAFHGQKVGAALQSIDDWWHEEADKPLRVNEYGADREYVIARRHVAYGNDFYQLLRNTENWIESMTASESIPNDVHFIMSVLIKGGLFNCAKAN

SEQ ID NO: 1887 - protein, 212 aa, Vibrio cholerae strain OYP7G04
MSQRYYFLIRYTNANADYGLLAGRCISQMHLFMVNHHQAMNRVGVSFPDWNESSVGQTIAFVSEDKEMMIGLSFQPYFSLMVNEGLFEISSVYEVPDTSEEVRFVRNQTIGKNFLGSKKRRIKRSMARAELFGIQQSLPVTNEDRAIDSFHQIPISSGSSRQDYILFIQKELADERAESGFNSYGFATNQEKRATVPDLRFNPFDEDSFLVQ

SEQ ID NO: 1888 - protein, 207 aa, Vibrio cholerae strain M1517
MFDQTKKSSHVHNICKFMSLKNDAVVRTLSILEFDFCFHLEYNPNIKSFTSQPFGFHYLFNNRKCRYTPDFLAIGHNEQSTFFEVKHSSQIPKPDFRERFEEKQRVALSEFNRRLVLVTEKQIRMGPTLDNFKLLHRYSGLRTVTEFQKRVLAFIQRKQMVKLQEVSLYFGLSEQDTLISTLPWISSGHVKTDLNTIGFGLETCVWC

SEQ ID NO: 1889 - protein, 621 aa, Vibrio cholerae strain M1517
MPPDSNSIFGFFDEFEASEEESQLLPKELILEPVEISSTIDSLPAKIQEEVLRRIKVITFVEKRLKGGWTEKNLNPILSLVESELQLTPPSWRTVATWKKSYAEAGREASALIPKHTFKGNRQKEMDSQSLIDEAIQNVYLTRERLSVAEAYRYYKSRVIQMNRGIVEGKIKPIAERSFYNRINELPPYEVAIARFGKRYADREYRSVGQQVVATKPMEFVEIDHTPVPVILIDDELDIPLGRPYLTMLYDRFSKCIVGCSINFREPSFDSVRKALLNSLLDKSWLKAKYPSIENEWPCHGKIDCLVVDNGAEFWSQSLEDSLRPLVSDIQYSQAAKPWRKSGIEKLFDQMNKGLVNALPGKTFTNPTQLQDYNPKKDAVVRVSVFLELLHKWIVDYYHMAPDSREREIPYHKWHQSKWTPSYYDGAEKEQLRVELGLLRHRTIGVAGIRLHNLRYQSAELIEYRKYCTPNNGKQLFVKTKTDPSDISYIHVYLESEKKYIKVPAVDNSGYTNGLSLFEHQRIQKVRRLNTKDLADDEALADTFLYMKKRIHEETDRFRRVKSSKPNLPKTGNTSRLAKFNDVGSEGPNSINVTPVRLKSEVVSDASEYLDDDDFEDIEGY

SEQ ID NO: 1890 - protein, 365 aa, Vibrio cholerae strain M1517
MTMILKILKGISLNLTPKQLEQLKSFETCFIEYPAITEIYSIFDQLRFNHSLGGEPESFLLTGEAGSGKTALINNYLSRFQSGSTWGKQPVLSTRVPSRINEQNTLTQFLVDLDCKSGGRGIRRRNEIALGEAVVKQLKRKSVELIIVNEIQELVEFSTAEQRQVIANTFKYMSEEARVSFVLVGMPYADVIATEPQWNSRLSWRRKIDYFKLLKANSHSSKTASYGFDLEQKKHFARFVAGLSSRMGFDEPPVLTKNELLYPLFAMCRGECRALKHFLKDALLTSFNDNADTIDKAILSRTFAFKFPYLDNPFDRPLEQLSLHQIDSGSAYHLNAITTEDKIVAPRFTDAIPLSMLLSKNGLKA

SEQ ID NO: 1891 - protein, 403 aa, Vibrio cholerae strain M1517
MKTDIQHYSDESLESFLLRLSQEQGYERFSHFAEDIWFDTMEQHEAIAGAFPLELNRINIYHAQTTSQMRVRVLIHLENQLKLNNFGVLRLALSHSKAQFSPEYKAVHRLGSDYPFVFLGKRFTPICPLCISEAPYIRQQWQFLSQQACERHGCKLVHHCPECQSRLEYQTTESISQCECGFELRNSPVEDAPVAALLVARWLSGNDSKPLGLLKAEMTLSERYGFLLWYVNRYGDIENISFESFVEYCSCWPRVLKEELDELVNKADLIRIKDWKKTFFNEVFGALLKDCRQLPSRQLECNSVLTQVLAYFTKLMAAIPSSSKGNVGDVLLSPLEASTLLSCTTDEVYRLYEFGEIKAAIRPRMHTKIASHESAFTLRSVIETKLTRMCSENDGLSVYLPEW

SEQ ID NO: 1892 - protein, 695 aa, Vibrio cholerae strain M1517
MTKLSDLLAIEDEAIKQTALKKMFMPYTEDVCVDGYEQETLTILLNLSSSHQADRCSDWLDVARAQRYLKDRENLDASLAEIQWFHTHNLKFPDCRVKDQRIIARPLSTAEEFISSAVLDQRLGWAHNSAVYRHTLWLLNPFKWQSQPVCILLLIQQKNPVWLDLLTEFGLDVKSLARLQRAIEEQLPENSFPDSVSTYSKQLRFPWGDDYVSITPVVSHALQCELEIRARSPENKFSFVSSSLPNSASIGNLCGSLGGYMRVLNYPLGVKQAKGGTLTENRQKSGHYFDDYQVTNAKICQVLNRLIGSEPSKTQRQRERARKVRSKILRKQIALWMLPLIELRDIAESEPNQQQLEHDDTLAQAFLSLPEWELGSLAGEFNRRLHLAFQNNIYSAKFAYHPKLMQVAKAQVTWVLEQLSKPINNQDTVTGEQYIYLSSMRVQDAVAMSNPCLCGVPSLTAIWGFMHDYQRQFNQLVNNDSPVEFSSFAFYVRNENIQSTAKLTEPNSIAKARTVSNAKRPTIRSKRLADLEIDLVIRVHSESRISDFRSALKTALPVAFAGGALYQPQLSTQIEWLRTFTGRSELFHVLKGLPAYGRWLYPSEKQPTNFDELERLLTQDDDNLLVSLGYHLLEHPTKRDNAITGCHAYAENAIGLAKRINPIEVRFSGRDHFLNHAFWSIECSSETILIKNYRD

SEQ ID NO: 1893 - protein, 343 aa, Vibrio cholerae strain M1517
MELCTQLNYVRSLSAGKAYFYYLSESGEMCPLDVDRTRLRAPKGSYSEAYKGNKFVDKNVAPQDLAYSNPQFIEECYVKPGVDEIYCAFSLRIRANSLTPDMCSDDEVRSKLSMLAKIYKDLNGYKELAHRYAKNILLGTWLWRNRECRNITIEVTTSELDTFVVEHAQKLSWYGHWDGDSTECLERLTAYLERALSDPTEYFYMDVKAKMRVGWGDEVYPSQEFLDSREDGIPTKQLATVELLSGKETVAFHGQKVGAALQSIDDWWNENADKPLRVNEYGADREYVIARRHVTHGNDFYQLVRNTENWIETMTASRTIPNDVHFIMSVLIKGGLFNCAKAN

SEQ ID NO: 1894 - protein, 209 aa, Vibrio cholerae strain M1517
MSQRYYFLIRYTNANADYGLLAGRCISQMHLFMVNHHQAMNRVGVSFPDWNESSVGQTIAFVSEDKEMMIGLSFQPYFSLMVNEGLFEISSVYEVPDTSAEVRFVRNQTIGKNFLGSKKRRIKRSMARAELFGVEQSLPVTNEDRVIDSFHRIPISSGSSRQDFILFIQKELADERAKSGFNSYGFATNQEKRATVPDLRFNLFEEDSF

SEQ ID NO: 1895 - protein, 58 aa, Vibrio cholerae strain 4874
ATGTCTGCTCTACCTTCTCCTTCTACTACCACCCTGATTGCACTTGAAAGTGCATTTG

SEQ ID NO: 1896 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcatgtggctggggcttccacccatcttgtcgctgaaatcataaagcgtcccaaaaaaaccataaaatgtcccaataaaacccataaagtgtcctaaacttattttggttgtttttttacaacgaaaaaggacatgttatgtacgttcgcaatcttcgaaaaccttcagcaaacaaaaacgtttataagtttgttagtgtaaaaaatggctgcaatatcatgtgcgaaagctcattggaatatgattgttgctactatttagaatattcggatgatgagaagtgtcgcctactcataggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgatcgatcctcagtaatagcaaaccttgttacattggcatggttagtcgctgtgatagttagccgtgtgatcaccaagaggtgtggttttctctactgcacttctgcataaaacagtaagtagttttctttcacaattttcctcagtgttaaaccgaagcagaaaataggacacgttatgctttcatcttaggacactatatggttttactgtgttggtaatggattgatttgtaatggagcgttaggacatcttatggtttcagcgacacatctatgtcgctgaaagcataaaggacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1897 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgatgtggctggggtctccgcccatctgaatcctgcaatatatgttcgcataaattgcaggctttcttcatatttgcaccataagttttcatagtctatttttttgttgtaggtttacaacaaaagtgattgtgctatgttcgatcaaaccaagaagtcatctcacgtgcacaacatctgtaagttcatgagcttgaagaatgatgcagttgttcgcactctgtccattttagagtttgatttctgttttcacctcgaatacaacgcagacatcaacgaacaccgattaccaagacggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtacctcaacgcttccaacctttgagcgtatgccatagagcgccaactctaacgcttttgtgtccaaaagtgtgtttcatacatactccccatccaatgtgatcaccatccatttcagagggctcacaggaggtggtaattttacaacgttggatttgggtagttgctaaaatttgcagagttttggcgcaatattatgcgaacttatgctgcaaatagtattttaacacgttgatagttggttcgcgttatgaagacttatcttgcaagcatcaccatctgctctacagaaaatccttcgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1898 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagctaacgtttaaaacactcgttcaaaatgtaaaaaaaaccatacgttgattttacgaaaccatacgctgaaataaaaacaaccataccttgaaattgcttataaagtgtacaacacttgagaaagtttactacaggtatggttgtttattatgaaaaaacggattcttagaaactcgtcagtaaaaaacatctcacgctttgtcagtctcaaaacgaactctatccatacagtcgaatccgacttggagtttgacgcatgtttccacttcgaattttaacgcttcaactcgacatctggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccctgagcatacggtcaaggattgatgaattctatagttttttagctttcgagttcgcccccaatgccggtgaaaacatgctatgcagtacaaatcaggcataagtgtaagttctgtaagaaagtttcttactaaactatgaaggttggaatatccttttcaccaaaatatcaacttatggttgttttatgcgatatcaagatatggttgtttttcgattaagcctatgattttaattgattcgttgttatcactttatggttgtttcaacacaaaattttaagaattgagccacttgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1899 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgatgtggctgggttcccaccccttatgaagcctgcaatatatgttcgcataaattgcaggcttcttttcttatttgcaccctaagtcttcatggtctattttttgttgtaggtttacaacaaaagtgcttttgctatgtacgaccaaaccaaaaaatcatcagctgttcacaacatttgtaaattcatgagtttgaaaaatgactcagttgttcgaacaatgtccatgcttgagtatgatttttgttttcatgctgaatacaatcctcaaatagtcgaaatgccccagtgtagtgggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtacctatgccggacaactatttccgacttgctaaattagcaaagacactaactcaaaattgtccaaaaccttcagagactgaattcttacccatacatgtacactatgtctttcgaagggttgatcggagtgtggtaattttactacgttgaattttagtagttctgtaaatatgcagactttcgatgcaatgttatgcgaacttatgttgcaaatagtactttaactctttgatacttggttcgaattatgcggacttatgttgcaagcatcaccttaaaaaagccgctctttatgaggacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1900 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgatgtggctggggcttccacccaactgatgcttgcaaaattactctgcataaattgcaaagaagtctacaaatttgcaaaataagcctgcataaactacctttagttgtaagtttacaacatagaggtgaatatcatgtacgttcgtacactaaaacaatctcaagtaaaaaacattagcaaatttatgagcctgaagaatgattcgatcattcgtacagaatctatgcttgaatttgatatgtgctttcatcttgaatattctcctgatgttgtacgcccctatccattttagcggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtaccgagacgggtttaaggaggaagattttatgatacaaaagttatctgtatttatctaatttaagtggctactctaagaaggttctgtccaaaaaaaagttacatttattaataacacatgaaattaaattacatactaaaattacagtcatattttaaggtaaaacattttgcagactatcactgcaaaaccatgtgatcttatgttgcaaattcaaaactaagcttttgatttttatatgagagctatgcaagcttatgttgcaagcatcaccaactgatgcttgcaaaatcactcgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1901 - DNA, 3229 bp, Artificial Sequence
  Synthetic
ctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgaacctccaaaacttcctctttttttgtcgctttcaacataagttgtcattattttcaggaaaagctgtcgagttttcaggaaaaactgtcataacgttaattctaaattaacttcagattaagatttacgaaaagctctcaaaaaaattgagtttatccgataagcgttcagtatgtgatcttcagttagttgaaggtgagcgctatgcctatatcgcgtcgaaatattagtcactcaagagttaaaaatctttctaagctctctaacttcaaaccgctaccgaaggaactcttggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgccctggtacctaaggtcgtgaccggaatcaagtaaccaccactcttatacattatcctctataatttcacttttttcttctaatcgaaggggctaatcaaatcgagttttctggtactattttagcattggaaactgagcagttttatgacagttattactgcaataaatttgctttatgacagctattactgaaaattatgacagcattaactgacaaaccgttctttacagtccgcattcacttgttcgtcttatgacaataattcctgaaagcaacattttttgtcgctttcaattttgaatgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1902 - DNA, 12039 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgttccgccgaataggcggctaagaaaagtacagcgcggctgaaatcatcattaaagcggtgttccgccgaataggcggctaagaaatagcgaattccgagcgaaggagatattcatatggatacggacatcgaagtttactctgatgaatctctcgaaagttttttactacgcttgagtaagtttcaaggctacgagcggtttgctcatttcgctgaggacatttggcaaactacgttattgcaacatgaggctattcccggcgcatttcctttcgagttaagtcgaatcaacatctataaagctcaaacaacgagccaaatgcgagttcgagtacttatagatttggaaaagcggctgaaatttaacgactttggcgttctacggctatcgcttgctcattctaaagcaagtttctctccagattataaagcggtaaatcgctatggtgctgattatcctcaagcctttcttagaaaaaacttcacacctgtttgccctaaatgcctagacgaagctgcttatattcgtcagttgtggcatttcattccctaccaagtttgccataaacaccacagccaactcgctcaacgatgccccgaatgcggaaaattattgaactaccaatcgtcagagctaatagagaattgtgaatgtggtttttccttacttaatggcgaatcagagaaggaaagctgttctactttatttgttgcacagtggctggcaggggagaaacccgtagaatcaggattaatgagtcaggaactcactcaatcaagtcggtttggatttctgctttggtatatcaaccgatatggtgaacttgatgatattagttttgatggctttgttgagtgttgtaaatcttggccgaacaagctcaataccgatttagattctattgtgcagaaggctgacatagtgcgaatccagccttggaacaaaatctacttcagtgaagtgtttggtgacttgttgaaagagtgtcgcagcctaccaagccgtgatcttagtaaaaatccggtgctgaaaaatgtagttctatatttcagagctttaatcaccaataatcctaaagtgaaatcagcaaacataggtgatgtattattaagccctttagaggcttctacattgctttcatgtaccacagacgaaatatatcgcctgtaccagtttggacagcttaaagctcaacacacgcccaagttgcagagtaaaatagaaaaccatcactctgttttcactcttcgtagcattatcgaactcaagttatccagtatgtgtagtgaaactgatggtttaaatcattatttgccagagtggtaagctatgacaactttgcaagatttaatcgatattgaggactctaagctccgatttatagagataaaaaaagcgtttatgccgtatacacgaccagtagaagttgatgggagtgaaaaacaggcattaattgttttactcaatctttcattgagtaaaccggaagtgaaagactggctcgattttcctcgcgctttggactatttcgccgattcagataacttatcggcggctgaacaagaaattcagtggtttcatacccataaccttaagttcccagattgccgagtatcagagcagcgaatcatagctacacctctgtacactgagactcctacactcacgagtcagtcattaaacagagcttatggctgggcgcacaattccgctgtttataaacatactatctggttattaaatgagttccggtggcgtggaagagtggaaaatctgcttaatcttatttgtggtggtgatgatttttggctggaacttttagctgatatgggattaaaacctaaagcacaaatacagcttaaagatctaattgaacatcagttaccgttgactcattttcccgacgaagtgaaccgctacagcaagcagctccgtttcccttggaggggggattacctatcagtaacccctgtggttagccatgctatacagcagcaactctctgttttgtctcgtcaaggtgaatgttctcttcgctttaaaacaatgacctatccaaattcagctagtattggaaatttatgtggttcactgggaggatatataaatgtactcaattatccgattgacgtaattgcgaatcgacatcaaacactcggtgcaagccgcagtagaaccaagcgctactttgatgattttcagttaacgtcaaaaagtacctgtagtgtattggctcatctgacaggttttgaacaacctcaaatgcgcaaagcgcagaaacacgttcgccagtatcaactgaaaattatacgtaaacaaatcgctttatggttactcccgcttattgaattacgggataattcagtcactgatccgattggcttttatgatgaaccagatgatgaactggcgaagcgattcttgaccatcaatgagcttgattttatagaactcacaaccagcttaaatcagcgcttgaatatagctttacagaacaaccgctttgcttctcgttttgcctaccatcccaaactgatgcgtgtgttaaaaacagagcttatttgggtgctaactcagctaagtcaacctgaaccagaacctcctactgtttctgatagtaaagtgcagtatctttacctttcatctatgagagtatttgatgctgctgcaatgagttgcccgtacttatctggtgcgccttcattaacggcggtgtggggatttgttcatcgttaccagagagagctacaagatttgctatctgatggagaagggcaattcgagtttaaagattttgctttttttattcgtgatgaatccgtacaaaccagcgcaaagctcaccgaacccagtgtaatagcaaaagctcggagtatttcacaagttaagcgaaccacgatcattcgtgaagattgctcggatttaatattcgatattgtaattgcaatagaaagtgaccaacgaatttcagattaccaaagccagtttaaagctgcattaccaactaatttcgctggaggggccttgtttcaacccgagattaattcagggattaattggttaagaacctttgtaagtaagtcagaattgttccaagcggtgaaaggtttaccgggctatggtacttggttgtcaccagattcttttcaacctcaaaatctggctgagttacaagagtgtttaacgattgatagttcgctaattcctgtatcaaatggctttcattttctagggtcgccacaggaacggaagggggcattgacgaagcttcattgttatgcggaaaacaacattgctttagctaaacgaaccaatccaatagaagtaagatttgccggtagtgatcacttttttgagcaggtgttttggtcgctggaagtgacagagcagactatccttataaaaaacaaaaggatttagccgcctatggaactctgtagtcagttaaattatgttcgctcgttatcacctggcagagcatatttttattatcttgatgaagataataagatgcgtccacttcagatagacaggactcatttacgagcacccaaaagtggctattcagaggctttctcgggtaatttcaaatctaaaaatatagctccgcaagatctttcctattcaaacccacaattcattgaagagtgttacgtgccgcccggagtaaatgacatctattgtgctttctcgttaagagttcgagcgaactcattatcaccagaagtatgtgttgataatgaggttcgagacatactctgtaattttgcggcactgtataaagaattaggaggttatcgggagctggcaaggcgttatgccaaaaatattttgatgggtacgtgggtttggcgtaaccgagagtgcagaaatataagggttgaagttaaaacagaagataaagagtgggtaattactgacgcaaggtttttagattggtatggctcgtgggagaaggattcacaattagccttagatgaatttactgactatttgtctcaagcattgtctgatagaacctgctatttcaatatggatattaaagcgaagctcactgtaggttggggcgatgaggtttacccaagccaagagttcttagatgtgaaagaagcaggaaagccaagcaaactgttggcaaaagtaaccgtcaatggcgaagagtcagcagcctttcattcgcagaaagtgggagcggcgattcaacgaatcgatgactggtgggatgaaaatgccgataagccgcttcgcgttaatgaatatggagcagacaaagaatatgcaatagcaaggcgacatagttcacgacaccgggacttctactcattgattgcacacactgaaagctatgttgaattgatgctagaaacgaatctgatctcagatgatgtccactttatcatggcagtactaactaaaggtggagtgttcagcggtgcaagcaagaaaagcaagaaggatgagtaatggaatctcgctattatttttctattcgatatattcctgaacacgttgacaatgaactattggcaggtcggtgtatttctaatatgcatgggtttctttctcacgaacgcaacacgcaattcaaaaatagtgtgggtatttgtttccccctttggaatgaacaaacggtcggtaatgtgattacttttgtctcgactaatgaaagtatcctcactggcctatcataccaaccttacttctctacaatgatgaacgagaacctctttgaaatctcaggtattaggattgttcctgatgacgctaaggacgttcgatttgtattcaataaaacaattcaaaagatattcaatggttctaaaaagcgaagaattaaacgagcgatgaaacgtgctgaagaatttggtcatactttcacacctatatcagttgaagtacgggagtttgagttgttccacgagattcctataaacagcaaatcatcaggacgtgatttcgttctacatatacaacgccaaaatccagtggaagcggaaataggacagggatttaatggctatggttttgcatcaaatcagctatggcgaagaacagtcccacttatcttgttttgacctttaataaggagatatagcatgtacgttcgcaatcttcgtaaaccttcagcaaacaaaaacgtttataagtttgttagtgtaaaaaatggctgcaatatcatgtgcgaaagctcattggaatatgattgttgctactatctcgagtattcggatgatgttgttcgttaccagtcacagccgaaaggataccgttttccttatcaaggtaaagaacatccatacacccctgattttttagtccataagaaagatggaacgtcttatctcctcgaagtaaaaccactatcaaaaacattcagctccgagttccaagatgtatttcgccaaaaacaaatcatggcaagtgaattgggggcacctctattactcgtgacagaccgccaaattcggaacgatgtgcaccttaataatttaaaactcgtacatcgttatagcggttgtatcggaaattctagccatttggaaagtgtttggtcagccgttaatcaatcctcatcgatttgtattaaggcgttatctgcaattttgaatctaaccattggtgaagtttttgcttccgtactacgtcttattggtttaggaaaagccaaaacaaaattggatgttttactggatgaaaattctttaatttcggtggcttaatatgtcttttgggccatttgaagatgagttcggttcaataacaaatgacgttcagcaacaatatgaggcaagccctgaagctaaactatctcggctgaagtattcacctcttgaaaccaccaaggttattgagcgagatctatcttcttttcctgaagaacaaaaactaaaagcgctggaacgttataaattaatctctttgattgctaaggagataaatggtggctggacacctaaaaatcttatcccattgatagataagcatatagaaacacttaatataccgaagcccagtgatcgtacagtaaaacgttggtataaggctttttgtgaaagcgatggtgatattaagagtttggttgatagtcatcacttaaagggaaaccggcagcccagaattgaggacgatgaaccgttttttatagaggctgttgaacgttttttagatgctgttcgtccttcttactctaaggcttatcaggtttactgtgaccgaattgaaattgaaaatagcactatcgtttcaggtaagatagcgaaagtcagctatgaggctttcaagaaacggctcaaaaaactccctccatataccgtcgctctcaagcgtcatggtaaatattacgccgacaaactgtttaactactatgaagcagtcaagatgcctacgcgtatcctggaaagagtagagattgaccatactcctctggatttaatcttgctcgatgatgagctgcttgtgccgttggggagagcctatttaactttattagttgatgtgtttagtggctgtataattggatttcatctcggtttcaaagcaccaagttatactgcggtttcaaaggcaattatccattcagttaaatcaaaggaatacgttaatgaattgccaatcggattgtcgaaccaatggatttgtcatggaaaaatagaaaatcttgttgttgataacggtgctgagttttggtcgaaaagtttagaccaagcatgtattgaggctggtatcaacataatctataacaaagttcgtaagccttggttaaagccctttgttgagagaaaatttggtgaactaattcaaggtattgtgggatgggttcctggcagaacattttccaatgttcttgagaaagaagattatgaccctcaaaaagatgctgtgatgcgttttagtgttttcgttgaagagttacatcgctggattattgatgtgcataacgcttcagcggatagccgacatacgcggatacctaattatcattggcaaaagagtgaagaagtattgccacctcctgctttgactgagcgtgacgagatacaattccgtgtaattatggggatggttcataaaggggcattaaccagtaaagggataaaatttaagcacttaatgtacgacaatgtggcgttagaacactatcgtaaacagtatccgcaatccaaagatagcaggataaaaacggtcaagattgaccctgatgacttatctcgtatctttgtgtttcttgaagaaaaaaagggttatatagaagtcccttgtaagtatgacccacttggttacaccaaaaaacttagcctttgtgagcatttaagaacggtaaaagtacaccgtgattttataaaaggacaagttgattcattatcactagctaaagcacgtcaggctttgcatgagagaattaagcaggaacatgaaaacttacgtcagatgtcgttacctcatcgtgctaaaaaggctaaaaacggtaagaaaatggctgaactggctggtgttaacagcgatagccctaaatccataacaaccgattatccgatagaggacaccatacaacttcacgaatctacacctgtcgatgatctccaatcactttggaataagcgcagggcattaaggaagtccggaaaatgacatcgcttcagccaacgaataatgacgtcgatgtattactagctgagttccatcagtcattcgtcgtttatccagatgttgaaaaggtttttgaaggtttagattggattgttcgtcgcagccagttcggtaagtttgcgccttctatgctaattacaggcgggacaggtgcgggaaagacttcagtggttgaaatctatttgaacaaccatttttcctcttcagaagtgttaatcacaagagtcaggccaagttttgttgaaacattaatttgggcgatcgaaaagctgaatgttccttacaacagtcggtcgaaacggtctgagattggcctacaagattatttcatcaatagtgttaagaaatctaagctgaagctgttggttatagaagaagctcaagaattgtttgagtgcgcatctcctaaagaaaggcaaaaaatacgtgaccgattaaagatgatcagtgatgaatgtcgattacctatcgtctttattggtattcctaccgccaaacttatcttggaagattcacaatgggacagacgaattatggtgaagcgagacttgccatatatccgaataacgaacgaagagtctttagatgtctatattgccttacttgaggggcttgaaaagaccttacctatttcagtcgctccagaactgactgatatggacatggctatgcgtttattagctgccagtagagggatgctcggtttaatcaaagaacttgtaggttatgcgtttgaactggctttactcgaaggtaaacgtcagattactcaaaacgaatttgttcaggcatttaaatctatttttggtcccgatattagtaacccatttgagattgaactggataaattactaatcccgcagattattgagtatgaaggctatcttttggactcagatagtggggacatcaagtttactcatcagatatttgaggacataccattaacagaattactacgctaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1903 - DNA, 12092 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgacctgccgcataggcagctaagaatagtacagcgcggctgaaatcatcattaaagcggtgacctgccgcataggcagctaagaattagcgaattccgagcgaaggagatatacatatgaataccgaccttcaactataccctgacgagtcgctagagagcttcttgttacgcttatcgcaagaacaaggctacgagcgattttctcattttgctgaggacatctggtttgacacgatggatcagcatgaagcgatttctggtgctttccctttagaactcaatcgagtcaacatctaccacgctcaaacaacaagccaaatgcgagcgcgggttcttattcaccttgagaaccaattcaagctcaataactttggtgtactgcgtctcgcgctatcacactcgaaagctcaattctctccgcaatacaaagcggtacatagattcgggtctgactacccgtatgcttttcttcgcaaacgcttcacgccaatttgccctctgtgtattagcgaagctccctacattcgccagcagtggcaatatatctctcaccaagcctgtgaacatcatggctgtaaactggttcatcactgccctgagtgtatatcgagactagaatatcaaggaaccgagagcattagccagtgtgaatgtggttatgaactccgaaactcgccagtagaggacgcgtcagaggctgaggtattggtagctcgatggttatcaggaagcgattcaaaacccttgggattattgaaagcaggaatgactttatctgaacgctacggttttttaatttggtatgtaagtcgctatagtgacgtcgatgatattagctttgaagcctttattgactattgcttcgcatggccaacatcactcaaagaggacttagatgcattggtgctaaaagctgatgtagttcgagtgagagattggcgaaaggctttcttttcagaggcgtttggcagcttgcttaaagactgtcgtcatttgccgagccgcgagttgagtaaaaacttagtgttgaatgaagtgttgaggtatctctcagggcttgtttcggataacccagcctcatctaagggaaatgttggtgatgtgcttctaagcccgttagaagcctctacattgctttcttgcacaacagatgaagtatatcggctctatgagtttggtgaaatcaaagctgctattcggccgcgtatgcatactaaaatagccagccatgaatcggctttcacgctaagaagcgtggtagaaactaagctaactcgaatgagttcagaaatggatgggctttgcgtatatttgccggagtggtaagcatgacgaaacttattgagttgctctcaatcgaagatgcgaataaaaagcaggcaatgcttaagaaatggttcatgccttacaccgcagacattgaagtggacgggcttgaggagacggcattaacggtactagttaacctaagctctcatcataaaggcgataaatgcaatgactggttagacaaagtccgtgcgaagcagcatttgagcgattcagaaaacatagactcatcaataggggaattgaaatggtttcactcgcacaatttgaaatatccagactgccgcgtagcagagcagaggctgattgctaaacctttgcaaaccgatgaagtgtttatttcgggaagaagtcttgaaccgagtttaggctgggcgcacaactcagcatattaccgacacgtattgtggttattgaatccttttcgttggcaatccaaatcaaccaatgttctcacgctagtgcgagaaggacaccacatttggttagcgttattgcaagactttgggttagaggtcaaaactctcgtcgctttgcaaaaggcgattaacgcacaagttccagattcaacctttcctacatcagtcagttcgtatagcaagcagttacgatttccgtgggagaacgactatgtatccattaccccggttgtgaaccactcaatacagcgagagctggaggttcgagcgcgggataaggagagcaaactgagttttgttacctcatcactgcccaattccgcaagtattggaagcctttgcggaagccttggtgggaacatgaaaataatgaactatccacttggggtaaaatcgacactaaatgggacgttagcgacaaaccgcaataaaacaggtcgctactttgatgattatcaagttacaaatcatcaagtctgcttggtgctcagcaggttgactggcagtgaaccactcaaaactaacaagcaaagagataaagcacgcaatgtccaaagtaagatcttgagaaagcagatagcgctatggatgttgccattaattgaattgcgcgatcgagctaatttaaatccaagtgagcagtttttaaatagcctagattctttagcgagtgcatttttgacgttacccgagtcagagcttaaatcactcgcaacccaattcaatcaccgacttcactatgtgctgcaagaaaataaatttactcataagtttgcttatcaccccaaactattacaagtcattaagtgtcagatagtttgggtactgaatcagttgagtaagccgagcactagtgatgaaactactcaaagcgaacaatacatctatctgacttccatgcgagttcaggatgcggtggcgatgagtagtccatacttgagtggagcaccgtcacttaccgccctttggggctttatgcaccgttatcagagagagtttagtcagttaatcggtagcgactcatcattggagttctcaagtttttcttttttcgttcgtagtgaggatatacagtccacagccaaactgactgagccaaattcagtagcaactaaaagaacagtttctaatgctaaacgtcctacgattcgttctgagaggttagccgatttagaaatagatatggtgattcgagtcaagggtcacgagcgtttagcagaccacttcagcgagttaaaagcgtcgttaccaatggcttttgcgggaggatacttattccagcctccgatttcatctgaggttaactggctaaacatttttggcagccagtcagaagtgttccacgcgattaaaggagcaccaacatacgggcgttggttatacccaagcgagttgcagcccagtagctttgacgagcttgaattgcagatttcaagcgatgccgacattcatccagtttctctcggctatcatttgctggaaaaaccgacatttcgtgagaactcgataacagagtgtcatgcttatgcagagaacgcgataggggttgcaaaacgcgttaatccgattgaagttcgatttagtggtcgaggtcactattttgagcatgcgttttggtcgctagaatacagctacgcaactattcttatgaaaaactataggaattagatgcttatggatttgtgtagccagctgaattatgttcgttcactttccccaggtaaggcgtatttttactacttatcaaaagatggtgagatgtgtcctgttggtattgatagaacaaggttgcgagcaccaaaagcaggctattccgaggcttacaaaggcaacaatttttttgcaaaaaatgttgctccccaagacttggcttacgctaatcctcaatacattgaagagtgttatgttactccaggggttgatgatatttattgtgcattttctcttcgtatccgtgctaattctttgttccctgaagtatgtaataacgatgatgtacgcaatgcgttagtgtccttgagttcggtatataaggagcttaatggataccaagagctggcgcaccgttatgccaaaaatattctatcaggagcatggttgtggagaaataaagagtgtcgagcattatcaatcgaagtcacgactagcgaagaagagagaataattgttaatgatgcactgagactatcttggtatggacactgggatgaagagtcaacactaagccttgagcttttgatggcttatctaagccgagcgctatcagaccgttctgaatctttctacatggatattcgagcgaagctttctgttggttggggagatgaggtttacccgagccaagagtttttagataccaaagaggatggtattcctaccaagcagttggcaaccgtgaaactgagtaatggcaaagaaacggtggcgtttcatggtcagaaagtgggtgctgcgctgcaatctatagatgactggtggcatgaggacccagataaagttttaagagtgaacgaatatggtgctgatcgagagtatgtgatcgcaagaaggcatgtggcattagaaaatgacttttatcacctaatcaaaaataccgagagttgggtgaaggaaatgaacaaaacaaaagtgattccaaatgatgttcatttcattatgtctgtcttggttaaaggcggactctttaatggggcaagcggtaaggccaagtgagtgtgagtatgaacaaacgctatttcttctatatacgctatcttccagagcaggttgactgtggacttcttgctgggcgctgtattagccaaatgcacaagtttatggtcaataataaacaggctatgaatcaaataggagtgagttttccgtgttggtgtgcggattcagttggtaatagcatcgcctttatttctgaagataaagaccttttgatagggctaacatttcaaccttatttttctgtcatgaaggaagaagaactgtttgagttgtctgatgtacatcaagttccagaaggcgcaactgaattaagattcgtccgtaatcagacgataggcaaaagttttataggctctaaaaagcgaagaatgaaacgcagcattgctagagcagaactaacggattcacaatcattacccgttgcagatgaagatcgcgaggttgaacatttccatcgtattccaatttctagtggttcatctaggcaggacttcatcttacacgttcaaaaagaacacgttggcgagagcgtccctacaaactttaatagttatgggttcgccaccaaccaagataaacgaggaaccgtacctgatattcacatttaacctttaataaggagatatagcatgttcgatcaaaccaagaagtcatctcatgtgcacaacatctgtaagttcatgagcttgaagaatgatgcagttgttcgcactctgtccattttagagtttgatttctgttttcacctcgaatacaacgcagacatcaaaacctttacgtcccaaccttttggtttccactatcaattcaataatcgaaagtgccgatatacgcccgattttttggcgacagatcacgatgaacattcaactttctttgaagtaaaacactctagccagattctcaaacctgatttcagggaacgatttaaagagaaacaaagagttgcgttcaatgagtttaacagacgcttggttttagttactgagaagcaaattagaatgggaccaactttagataacttcaagctactacatcgttactctggattgcggaccgtgactgagtttcaaaagttagtgttggcgtttattcaacgtaaacaaatggtgaagttacaagaggtgtctttgtatttcggtttatcggagcaggacacacttatctctactctaccttggatctcttcggggcaagttaaaacaaacctcaataatattggctttggcctcgagacttacgtttggtgctaactatgccgtctgactccaataacatatttgggttctttgatgagtttgaggcttcagagggagagtcgcagcagcttccaatagagttaattcaagaacctattgaaatcttttccactattgatactcaatcaccaaaggtacagcaagaagttatccgccgtatcaaaatcatcgatttcgtagagaggcgcctaaaggggggatggaccgagaaaaacttgaatcctatcttgagtctcattgaaccagaattaaaacttactcccccgagttggcgaactttagcaacttggaaaaaatcttactttgaagcgggtaaagacccatgtgcacttattccgaagcatacgtttaagggcaaccgccaaaaagaaatggattcgcaatccttgattgatgaggcagttcagaacgtatacctgacacgtgaacgacttagcgtggcagaagcataccgatactataagagtcgagtgattcaaataaatcgcgggattgtcgaggggaaaatcaaaccaatttcagatcgttctttttataatcgaatacacgacttacctccgtatgaggtcgcgatcgcaaggtttggcaaacgatatgcggatcgggagtttcggtcagttggtcaacaggtagccgcgactaaaccaatggagtttgtcgaaattgaccatactccagttccagtgattttgatcgatgatgagttagagattcctttaggtcggccctatctgacgatgctatatgaccgcttcagtaaatgtatcgtaggatgcagtatcaactttagagagcctagttttgactctgtcagaaaggcgctattgaactcgctactagataagagttgggtaaagcaaaggtatccttctattgataatgaatggccttgccacggcaagattgactgtttagttgtcgataatggtgctgagttttggagtaaaagtttggaagattcgttacggcctctggtatcagacatccaatacagtcaagccgctaaaccttggcgaaagtcagggatcgaaaagctgtttgatcagatgaacaaagggttagtgaacgcactgcctggaaaaacgttcaccaatcctactcagctacaagattacaacccaaagaaggatgcggtggttagagtttccgtgtttcttgagctacttcataaatggattgtcgattattaccacatggcacctgattcaagagaacgtgacattccataccacaagtggaaccaatcggaatggactccctcttactactccggagttgagaaggagcagttgagagttgagctaggtttgcttagacacagaaccattggagtagcagggatcaggcttcataatctccactatcagtcctcagaacttattgaataccgtaaatattgggcgtctaacaatggcaaaaagctgtttgttaagaccaaaacagacccttctgacatcagctctattcatgtttatctggaatcggaaaagaggtacataaaagttccagcggtagacaacaccggatatacaaaggggctgtcgctttttgaacacgagcgaatacaaaaagtacgccggctcaatactaagcagcttactgatgatgaggcgcttgcggatacattcctgtatatgaagaaacgtattcaggaagaaaccgatagattccgcggtgcaaaaagcaataaggccagcttgcctaaaacgggcaatacttctaaattagcaaagtttaatgatgtgggatctgagggaccaagctcaatcaacgtgattcctgttacgcacaaatctgaggttgtttccgatgcctcagagtacttagatgacgatgattttgaagatattgaagggtattaatttgaatttaacgccaaagcagcttgagcagctaaagtcctttgaaaccagctttatcgagtatcccgcgataactgaaatctactctatctttgatcaacttcgtttcaatcactctttaggtggtgaaccagagtctttcttgttaactggtgaggctggaagtggaaagacggctttgatcaacaactacttatcacgctttcaatcgggttcaacttgggaaaaacagccagtgttaagcactagagtgccaagtcgtatcaatgaacagaatacgctgacccaatttttggttgatttagattgtaaatctggaggaagaggtattcggcgccgtaatgaaattgcgcttggcgaagcggttgtaaagcaacttaaacgtaaatctgttgagctgattattgttaatgaaattcaagagctggttgagttttcaaccgcagaacagagacaagttattgccaacacattcaaatatataagtgaagaagcaagagtctcgtttgtgctagtgggtatgccttatgctgatgtgatagcgacagaaccacagtggaactcgcgtctaagctggaggagaaagatagattatttcaaattgttgaaagcgaagagtcattctaatagaacggtatcttatgggtttgacttagaacaaaaaaaacattttgccagatttgtcgcgggtttgagtgcgagaatgggctttgatgaaccgccagtgcttacaaaaaatgaagtgttatatcctttgttcgttatgtgtagaggggagtgccgagcgttgaagcacttcttgaaagatgcactacttatgagtttcaatgagaacgtcgatacgataaacaaagcgatattgacgcgcacgttttcgtttaagtttccctatttggacaacccatttgactctcctgtagagcagcttcgccttcatcaaattgacgctggctctacttacaacctaaatgccattacagcagaagataagattctcgcgcctcgttttacagatgcaattccgttgagcatgttattgagcaaaatacgcttaaaacttagagtggctttcgtgatttagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1904 - DNA, 11817 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgaataggtagctgataatagtacagcgcggctgaaatcatcattaaagcggtgaactgccgaataggtagctgataattagcgaattccgagcgaaggagatatacatatgcttttacaaagacccaaaccacacagtaacgaaagtttggagagcttctttatccgagttgcaaataaaaatggctatgaagatgtgaaccgttttcttatggccacgaaacgttaccttcaagacatcgacttctcagggttccagaccttccctactaacatctgcaagatgaatcctgcgtcagccaaaagcagttccagtgcccgtacagcctcactcctgaaactcgctcaattaacgtttaacgaacctaccgagttacttggattagcagttaacagaacaaacttaaaatattctccatcaactagtgccgtgatccgtggctcagaagtttttcctcgcagtttactccgtacaaagtccataccctgctgcccattatgcttacaagaaaatggttacgcttcttacctttggcattttgagggttacgatcactgccatatccataatgtacctttactcaacagctgtcgctgtggtgctgagtacgactatcgagtgtctggtttaagtggaatgtgcggcagttgtgaagcacctatcgccataaagagtcgagaaaaaagtcataacgccacactctctgttgcgaattggctggcgggcaatgaatcaaaagatctgccagatctccctccaagctaccgttggggcttagtacattggtggattcatatcagcaatgatccgttcgagcacctttcgttcgtccaatttttctcgaactggccaagttcgtttcactccataattgatagtgagatcgagttcaatctggagcacgccattgtaggaaaaagtgaattacggataaaagatctcctggggcggatattgtttagttctgttcgtttaccagaacgcaaccttcagcacaatatcgttctaggagagcttctacggcatacagagatgcatttatgggataacaacggtctgatcgctaaccttcgtatgaacgctctggagactactgtattcctgaattgcagtaaggatgagttagcctcaatggtagaacagcgcatcttaaagccaaatcgtaaaactaagccaaacatacctctggtggttaacgactacttattttatttcggcgacatcttctgcctttggttagccgaatttcaaactgatgaatttaaccgctctttctatgtgtcgaggtggtaaatggagagtcttaaggagttactacaatcaagaccagatgatttgaacgtagagttaaagcgaacattccgccctcttactccacatatcaatatcgatggaaaggagcttgatgctctcactgtattagtgaacttaaccgacaaaacagccgttcaaaaagatctacttgatagggttaaatgcaagcaaaaacttagagacgaaaaatggtgggctcgctgtctaaaaacggttgaatacaggcaaagccacaacctaaaatttccagacatacgctctgaaggtgttattcgcgcgactcctctggggcagctacccgattttttactttcatcttctaaattagaaccacacaactgggcgtacagccatgattccagcgatgttaacaaaagcgctttattaaccaatgaatttcgctggaatggtgtaatttcatgccttggtgatttgcttaaagatgtagaacacccgttgtggcaaaaactcaatacgcttggctgctaccagaaaacacgtaaggctatcgctaaacagttggctcagatttctcaaacaacgattaacgtcagtctcgctccaaattacttaactcaactatctttgcctgataacgacagttcttatatttcactctcgccagtggcttctcaatcgatgcaaagtcactgttatcaagcgctaaaaaatgagtatcgctatacagcgttaacccgttacagtcgcagtactaacatgggagtattacctatgacctgtggtggtgctttgaagatgttgaaaactgtccctaacttttcccttacacatcattatcagataaacattggaaaatcttggttgacctcaagtcatattcaatcgttaaaacagtaccaaacgcatactcaatatttaatgccaaaaaacaagcgagtggcttaccgcagaacagtcaaaaacgagatacaagagatggttaaggcttggttggcaacacaagacaacacaatggatgttaatactcttgttcaacatttaaacgatgatctatcccgcttcaaatcagctaagtgtttcgcatacgagccgagcattactaaactcctgcttgggctcatcaagcgtgaactaaccgaacctacaaccgtttcaactaatatttgccgcagtgaaaaaaaggattcattctttgtgattccaaatataagagtttgtggagcaagcgcgttgagttcacctatcacggtcggtctgccatcactcactgctttcttggggtttactcacgcgtttgaacgtaacttaaatgagtcttttcctacgctcgcaatcgattcgtttgccatctgtgtccatcaactacacgttgaaaaacgcggtttaacaaaagaatatatacaaaaagcaaaccacaccatatcgccacccgctacatacgatgactggcagtctgatttggtctttagtttggtgattaggtttaatcgtagcttgaacgttgatgacaatactattgttcgtgctctgccgaaacggtttgccagaggttccgctaaaatagctattgcagatttcaaatacatccggtcattttcaacgttagaaaagacgattcaatcctttcctcagaaaaccggcaaatggctatcgatgcatactgaacctatcgaaaacatgagtgatattttatcggaagttaaagagaaccgaaaattaaccccaagctgtgttgggtatcattttcttgaggagccgaccgacaaacctaactctcttcgaggttataaacatgctttttctgagtgcatcattggtctgattgagccaatcacttttgatcaaaacaccgacataaatactattttgtggcatcacaagtgctatcaaaactacctttctgtgcagccaaggagtacctatcatggaactaccgactaacctagcctatgaacgctctattgatccttctgatgtgtgctttctagttgtgtggccagatgggcgaaagacccccttaacctacacttctcgtactgtactaggacaaatggaaaccgcagccttagcttatgagccgtcggggcggaccaaagagagtgcaaccgctgaaaagcttgctcaaggaaacccacatcaagtcgatttttgtcatgctcctttcggtgcgagccacattgaatgctacttttcggtttctttttcttctgagctacgcaaaccttacaagtgtaattcgtctacggttaaacacacactaatgcagctaatcaaagcgtatgaagaaaatattggatggaatgaattggtttctcgttatctagtcaatatatgtaatggatcatggctgtggaaaaatactaaaaaagcctattgctgggatatagagttaaccccttggccctgggcgggaggtgctgtcaaatttcaaaacataagggctaactaccttgaaagaagtgactttgagaaccataaagattgggaagctattgctcaaatgaccaaaaatgctttttctcactctaatggtttggccatatttgaagtaaaagccaccttgcggctaccaaccaataaacagattttcccgagccaagcattcaccgaaaatgaaagtaacaacactaataaatctaagaaacaaagcaagggacgaatttttcaaagcacaacggttgacggtgaacggagcccaatattgggtatttataaaactggtgccgccattgcgaccatagacgactggtatcccgatgcaactgaggcactacgtgtcggccggtttggggttcataaagaagatgtcacttgctaccgtcacccttctacacaaaaagatttcttttttatacttcagcacacagagtcttatattgaagcactcacgtcctcagataaaccaaatcaagaaaccataaacgacctgcattttttggtcgcaaatatcatcaagggtggaatgttccagcataagggaaattaagtatgaagtggtactacaaaacggtcacttttctgccagcgcgttgtaacaatgaatcattagccgctaagtgccttcggattcttcatggctttaactatgagtatgaaacaagaaatattggcgtttcatttcctctttggagtgactataccatcggaaataaaatttcttttgtgagcacaaataaaatcgaactcgatttgctactcaaacagcactacttcacccaaatgaaagagctgcactattttgatatatcaaatacaaaggttgtccctgacggctgcgagtatgtttcatttaagcgttgccagtcaatagacaaagcaacacctgccggacaagctagaaaagcgaaaagattaaaaaaacgtgcggaagaaagaggtgaagtgtttgacttatcctcgttcaaacaacacgaagttgttgcactccatcactaccactcacttgaggaggacagtaaaagtcgtggaggtagttttcgactcaatataagaacattcaaagaagctcgcttagacggagatgcactatttagcagctatggtcttgcgaatactggaaacaaatctcaacccgtccccctaatttgacctttaataaggagatatagcatgaaaaaacggattcttagaaactcgtcagtaaaaaacatctcacgctttgtcagtctcaaaacgaactctatccatacagtcgaatccgatttggagtttgacgcatgtttccacttcgagttttcgccacagattataactttcgaggcgcagcctatcggttttgaatattttatcgaaggtaaggtgcataggtatacgcccgactttttagtcacatacaaagattcataccaatcattttatgagataaagcccaagcacattgcagaaaaagatgagtttaaagaaaagtttagagcccagaaagaacaagcattgggcgacggtaaagacctgcacgtattgacagatgatgatattcaaatatacccattgctcgataacttgaggatcattcatcgttatgcttgcgatgagcgtcttaactctattcaaagaaatatattgaatctatttaagaaatatggagaactcaggatagagcaggttgttcaatattcttcagttcattcttctcagttattaccctcactttatgatttgattgctaggcagttgttaagtattgatatgcaccagcctattggttggcaaagccctatttggagttcttaggcatgccaagtgaaggttctaagcgatttggcgagctatttcctagtaccaacttcgataatgaatcgaaaccaaaggaaacgctatcactccccttatggaaagatgttgatctgacgtttaaggatgtcttttctgttgatgaggaccgaagaaatgaggccatacatagatataacattctcgagttccttatagatcaatatggaaccgatttttcaaaaaagcaaatagatgagtcacttactgctttaatagataaatttggttcaagtacaccatcagcaatcagcatttataggtactggagagattttaaaaaatcaaattttcagcttaactccctaattcctaaagtctctgctggcaatacaaaaagaaatactcccgatgaacttgaacctttaattcaaggtgcaataagaaattacttttctgaagaatgcccgacagcaacatcggcatacgtaactcttgaggttgaaattgatcggcataacgaaatcaatggaactcaatttgaaccgttctcaatacaggcatttaggaagagactaaggaagcactctgagtacgaaaaaatattacttagaaagggaaaaagtgtagctgattctactttcagaaaagtgggggaaaggccagcaacaacacgagtattggaacgtgtagaagcggaccatactaggcttgatttatttattattgatgaaaaaaacggtataccgttagggcgaccctggctcacagttttgtacgatactcatacaaagagcattgtgggtttctatctagggttcgagccgccgagttacttatcagtatcactggcacttgtgaatgcaattcttccaaaagaacacgtcaaagaactatacccatcagtagaagggtgttggccttgttatggcttacctgagcatttgattgtcgataatggtactgagtttaacagtagtgacttcaaaatagcgtgcaaagacctgaaaataaaagttaagaaaaacccgactaaaaagccttggcttaaagggtcagtagagcgatattttcgtactatcaataatcgatttctctccagaatgccgggtaagagttttactaatatatttgagagaaaagattacgatccactcaaaaatgcagttattgataattcgcttctgcaagaaatggttcatatctggatagtggatgtttaccaaaatggaaaaaacgggctagaaaacaatatcccaaatctaagttgggtcgatgctgttaattcttcaattcccccacgtcctttcaaagggtccagagatgaattgaagtttaacctgggaaaaaaccgtgaggtatctctcgataagaatggggttaggttaggcacaacaatacgctactccagtgttcgtctagcaagatattttggacacaaaacttgtaaagacatgaaaagtgtacgtgtgaggatcaagtatgatcctagttgtcttggtagggtttatgtacttgatgaaacgaaagaagagttttttgctgtagacgcaatcgatgctgattacgcctattctgtttctgagtggttacacaagacttgttgtaactatgcaaggcgacatattcgcaagaactacaaccacagagatgttgttaaggcttggcgtaaaattctcgatattattgatgaagcatttgaaaaaacaggtcaaaataagaaacaaaactctctagggactacaactacatctcgggtgcagcgtataaaagagcattctaaaagagcaacttccgaagcaaaaacacaacaagttgattatgtaaaatcagaacttgatgatgaattagattgggacatcgaggttaatactaatggttggtcgataaagtgattttattcaaaaaggctaactgacatggatagtaataaaacagaaagcacagctgagatggtcaaacaaatcttcattcagagcccgctaataaccgacattcttgatgatatttcagattgccgagaatttagtgacggtattcatgaaccagactgtatgatcgttgtgggagatactgggtccggaaaaacaacgctgataaataagtatttaaacgaaaaccctcgttcagagacaagcgaaggttcttttataccgattttatcgacttctctcccacccaatgcgaccccgattacggcttctgagcagttgctatctgatctaggggacccactcgctttttccagagggagtgatcctgtcaaggtcgcccaagaaatgagtgacttaatgaagtcatgcggagttgaattaattatcatagatgagtttcaacacatgatagatcggaagaataagcaaattttacatagtgcagctgactggttgaagatgctcattgtacgttcaaaggttccagtggtgctttttggcatgccttactcagtggtaattttggaggcaaatagtcaattagcaggacgcttcgagttacagcacactcttgagcctttccggttgaatagcaaaaataaccgtagtatctataaaacgtttttaacaatgcttgatgacgcattaccttttggtgagtgttctggtcttgctgaacctgacatgatgaagcgtatctacgcattttcccaaggtaatctacgtcgtatcagaaaactcattaatagagcgagtaggcttgcattacgtgatcattcaaataaagttgcattaaaacactttgccaaagcagcacccaaagtcagccaggtcgcatgtgaaaatctaaatccttttgaagttactattaaggaattgaagatcaatcatccccctcaagatattgggtgggaaaattatctgtttcaacaagaaaaagacgtatcggcaaaaggtttattttgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1905 - DNA, 12072 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgtcctgccgcataggcagctaagaagtacagcgcggctgaaatcatcattaaagcggtgtcctgccgcataggcagctaagatagcgaattccgagcgaaggagatatacatatgaaaacggacattcaactttaccctgacgaatcgctcgaaagtttcttgttgcgcttatcgcaagagcaaggttacgagcgattttctcatttcgccgaagatatttggttcgacactatggatcagcatgaggcgattgctggtgctttccccttagaactcgaacgagtcaatatctaccacgctcaaaccacaagccaaatgcgggtgcgagtgcttatccaccttgagaaccaattaaagctcaacaactttggtgtactgcgtctagcgttatcacattcaaaagctcaattctctccgcaatacaaagctgttcatagatttggtgttgactacccttatgcttttcttcgcaaacgcttcacgcctatttgccctctgtgtattggtgaagctccctacattcgccagcagtggcaatttatctctcaccaagcctgtgaacatcatggctgtaaactgatttatcactgccctgagtgtaagtcgagacttgaataccaacgtaccgagagtagtagtcaatgtgaatgtggtttcgagctgcgaaactcgccagtcgaagatgctccagaggctgaaaccttggttgcccgatggttgtcaggaaatgattcaaaacccttgggattgctgaaggcagaaatgacgttatctgagcgctatggtttcttactttggtatgtaaatcgctatggtgacatcgatggactctgttttgagtcattcatcgaatactgcggctcttggccaacgtcattgtggcaagacttcgatgttttgaaagagaaaacagaactcgtccgagcaaaagattggaagaagatgtttttcaatgaggcttttggtgctctgcttaaagattgccgtcagttacccagtcggcagctgagtcacaatatcgtgcttactcaggtgttagcttactttacacagctgatggcaacagtatcttcaagcgcgaaaggtaatataggtgatgtgctgctcagccccttagaggcttctacattgctttcttgtacaacagatgaggtatatcggttgtatgagtttggtgagatcaaagccgcgatcaggccgcgaatgcacacaaagattgcaagtcacgaatcggcgtttactctgagaagtatcattgaaacaaagttgacgcgaatgagttctgaaagtgatggtttaagcgtgtatctaccagagtggtaattatgacaaaattaagtgacctattggcaatcgaggacgaagtagtaaagcaggcttctcttaagaagatgttcatgccctatacggaagatgtctgtgttgaagggtttgaaaaagaagcgctaacgatcttgctcaatctcagttcaagccatcaagcggatagatgctcggattggttagatgttgcccgtgctaaaaggtattttaaagcggctgagaacctagacacatcccttgatgagatcaaatggttccacactcataatctcaagtttccagactgccgagttaaagatcagcgaataattgcgcagcctcttgtgacaaccgaggcatttatttcaagcgcagcattagagcaacgcttggggtgggcgcataactctgcggtgtatcgccatacattgtggttattgaatccttttcgttggcaatcacagtccgtgagtctgctttcacttattcagcaagaaacccctgtttggctcgaactgcttaaaggttttggtttaggcactaagtcacttgttcgcttacaaaacacaatggcagaacagctacctgaaaatagcctccctgacagagtcagtacttacagcaagcaactacggtttccgtggggggatgattatgtttcggtgacaccagtggtcagtcatgccatccaaagagagttagaagtgagatcgagaagtcgagaaagcaaactcagctttgtgtcctcatcgctgccaaactcggcaagtatcgggaatctgtgtggcagtttaggtgggcacatgaaagtccttaactacccgctagacgtcaaaccagcacaaggtgggacgttaactgaaagtcgcaaaaagagtggctgctactttgatgactatcaggtaactaacgccaaaatttgtcaggtgttaaatcacttaattggatcagaaccatcaaaaacacagaagcaaagagagatcgctcgtaaggttagaagtaagatattgcgaaagcagatagccttgtggatgcttccattaattgagctaagagatattgttgatgctgaccctaatcaacagcaattagaacatgatgacactttaactcaagccttttgggcgctaccagaatcggatctaggctctttagctagtgagtttaactgtcgcttacatctcgcgtttcaaaataataagtttgccgcaaagtttgcctatcaccccaaacttatgcaggtcgtcaaagcccaaatcgtatgggtactcgaacaaatcagtaaaccaaatggcaatgaagataaggtaacgggtgagcagtatatctatttgtcatcaatgagagtgcaagatgcggtcgcaatgagtagcccatacctatgtggtgctccttctttgacggctatttggggttttatgcatcgctatcaaagagagtttaataaactagctaattgtgattccctgtttgagttttcgagtttctctttttatgttcgtagtgagaacattcaaccgacggccaaacttaccgaacccaactcagtcgccaaagcgcgaacggtttctaacgcgaagcgaccaactattcgtagtgaacgattggcagacctagaaatagacttagttattagagtccatagtgacagccgaatttcagattttaagtccgcgcttaaaacagcacttcccgtagttttttctggaggggcattataccaaccacagctatcgacgcagattgagtggctaaggacgtttaccagcaggagtgagcttttccatgtcataaaaggcttaccagcatacgggcgatggttatatccaagtgaaaaccagccgagtgattttgatgagctagagcgttttattactaaagacgctgataatttgccagtttctattggctaccatttgttagaacaaccaactaaacggggcaactcaatcaccagttgtcacgcttatgcagagaatgcgatagggcttgctcagcgagtaaacccgatagaagtacgttttagtggaagagatcactttttaaaccacgccttttggtcgatagaatgcagtagcgaaactattcttataaaaaactatagggattaattgcttatggaactttgcactcagctgaattacgttcgatcactctctgctggcaaagcatatttctaccatctttctaaaagtggtgagatgtgtccccttgaagttgatagaactaggttgcgcgcaccaaaagggggttatgcagaagcctataaagggggcaagtttgtaaaaaagaatgttgctccacaagacttagcttactccaatcctcagttcattgaagagtgttacgtaaagccgggtgtagatgacatctactgtgcattcccccttcgtattcgagccaattctctaacccctgagatctgtagtgacgatgaagtgcgcagtaagctttcgttactggctaacacttataaagaactcaatgggtatcaggaactcgctcatcgatacgcgaaaaatatcctgcttggcagttggctgtggcgtaacagagagtgtcgaaagctgttgatagaagtgaccaccagtgattcacaaaccctgattgtagaaaacgcaacaaaactttcttggtatggtcattgggatgaggcttcagcagaatgcctagaaaagctcacagcctatttgatgcgagccctgtctaacccgaccgaatatttctatatggatgtcaaagctaaaattggagttggttggggagatgaggtttacccaagccaagagtttttagagagccgagaagatggtgttcctactaagcagttagctactgtcgaactattggacggaaaagaaaccgttgcgtttcatggtcaaaaagtgggagccgcgttgcaatcgattgacgattggtggcatgaaaacgcagataaacccttgagagtgaatgagtatggaactgaccgagagtacgttatagcaaggcgacacgtttcctatggaaatgacttttaccagttagtcagaaatacagagaattggattgagacaatgacagcttctcagaccatcccaaatgacgtgcactttattatgtcggtcttgattaaaggtggactcttcaactgttccaaagcgaagtaaggatgactatgacgacgcgttactacttctgtatacgttatacccctgttcaagccgactatgagctgttagcaggacgttgtatctctcaaatgcacttgtttatggtcaataaccgacaagccatcaataaaataggcgtgagttttcccgactggagtgatgttacggttggtcaaaccatagcctttgttgctgaagataaagagatgatggtaggactctcttttcaaccctatttttctttgatggtaaatgaaggtttatttgagatttccagtgtatgtgaggtgccggatactgcgatagaggtgaggtttacccgtaaccaaacgattgggaaaagttttctgggttccaagaaacgtcgaatcaaacgtagcatggcgagagccgaactatctggtgttgaaccatcgttaccagccactaatgaggagcgtgtcatcgatagttttcatcgaataccaatctccagcggttcatctggagaagattatatgttgtttgtacaaaaggagtttgtcggtgagcgcggtacagcaaactttaatagctatggtttagccaccaatcaagaaagaaaaggcacggttcctgagttacgtttttaacctttaataaggagatatagcatgtacgaccaaaccaaaaaatcatcagctgttcacaacatttgtaaattcatgagtttgaaaaatgactcagttgttcgtacaatgtccatgcttgagtatgatttttgttttcatgctgaatacaatcctcaaatagttagatatgaatctcagccacatgggtttgagtactacttcaatgggcgctattgccgctacacaccagactttcagcttttcgatagcatagatacgccttctctgattgaagtaaagcattcaagtcagatccttaaaccagattttcgagcaaggtttaaagaaaagcagcttgtcgctcaagctgagtatggaaaaaaactcatcttagtgaccgagaagcagattcgtactggttttctacttagtaaccttaaattactccacggctattcagggattcgtacaatcactgatattcaaaagcatgtgcttcagtttgttcaagctaatagaagcgtgacccttcattatctttcacaccaacttaaaatctctccagatgaaacattaacagcagctttgtgctggctatcttccggagaaatacaaacagattttaatcagaaaaaatttgatttggaaagttctgtttggtgctaggcaatgagtaatgatgctctctttggttttcgtgatgaatctagtagtttcgacaatgatgtagcagatgataaaacgcttcctacagaatttttagcagaggacgaaaatcttgaattggcatttggtgatctaccacacaaagagactgcattgtatcgtttggacttaattcgttatttggaaaggcacgtacaaggaggatggacgcccaaaaacctagataagctcttggaagagtatgctttattgaagaaaacttcggtcccgtcatccagaacggttgctgattggaaaaagctctattacgagtcaggtaaagatgtagcgtctcttgttcctgggcatagcaaaaaaggaaacagaatactaaagaatgattcatctgatttagtaacagaagcgattcaaaccaagtttctgaccaaagagcgagtatcagtcaacaccgcctatgagtactacaaatatcgagttattgaagagaaccgacaattaacgcaaattaaaatagcgacaatttcacaacggacattttacaatcgtgtaaatgcactacctccctatgaagttgctttggctcgttatggtaaacgatatgctgataataagtttaagactgttgggtcaatcattccggcaacgcgtccaatggaatgtgtagaaatagatcacactacagctcctgttattttgcttgatgatgatttggatcttcctcttggcagaccacacttaacaatcctttatgatagatactctacttgcattgttggtctttctgtcaattatagagatcctagttacgagacagtacgagcagctttcctcaattcagttctcaagaaggattgggttaaagaaaagtacccaagcattaaatctgaatggccttgctacggaaatattacaaatttgatagtggataacggtgcggagttttggagtgatagcctagagtcagcattaaagccattagtaacagatattcaatataatcaacgtggtaaaccgtggcgaaaagcgggtgttgaaaagtcttttgataccttctataagaaactatttagtcgtttcccaggaaaaaccttcacgaaccctactcagttaaaagactacaacccgaagcgagacgctgtcattaatgtgtctgattttctcgaactgttacataagtggcttattgacgtttatcataaaaaagctgacacgaggtacaagagagttccctaccagaaatggacagagtcgcaaggaaagataatcttttgtgaaggccctgaagcagagcaattaaagattgagcttggagttgtaaaccatcggactataagaagaggcgctattgaattgcattctcttaaataccaatctgatgaattggaagagtacggtaagcagtattctagtcgtgcaagaaaaagcgcttatgtgaaaaccaagacagacccaaacgacatcagctcgatttacgtttatctcgaggaagagaaaaaatacatcaaagtcccagcagtcgatcatacgggttatacaaaaggccgatctttatatgaacatcaacggattaacagtttaagaaggttgaaagttcgtttgggagagcaagacgaatcactagccgatgcgtcattgtatttggacagagctatggatgaagcaatagaacgtatgagtcgttctaagtccaaaaaatcggcgcttcctaaaacaactcatgcttcaaaaatagcaaagcaaagaggtgttggtagcgaagggcctagcaccattgtcattacgtcacctaaacctatcagtgaagtaccaaaagaagtaatagatattggtactgctagtgatgacctcagcgatatagaggggtattaatgaacatacttagtgagcttcaaatagagcaatatacatcttttagagagtgtttcttagaataccctcagctgacggaaatttataacgtctttgatcgaatggtattgaacagctgtcttggaggggaacaagagtcactattgctaacgggagatacaggtgttggcaagacggcgatgatagataattatgttgcaaggttcgctgctaagggtagccgctgggctgaaatgccagtattaaaaactcgcatcccaagtaaagttcgtgagcaaaatacgttagaaagattattaattgatttagatagtcgagcctctagccgccgcaggcgtccttacaaagaaggagcgttagaacaaggagtcatcaaaagtttagttgaaaaaaaagtgaagctggtgatcgttaatgaggttcaggagctgatggagttcaaagatgctaatgaacgacaaacaatagcgaatacttttaagatgataagtgaggaagctcaagtttcatttgtcttggtgggtatgccctatgcgactatgctcgctgaagaggaccaatggaactctcgtttaggctggaagcgacacttgagttattttcacctttctaagctgagcgaagccgataacaaaggttatatacctgatgcagaagggaaacggcattttgcaagttttgttgccggacttgcaggccggatggggtttgaaaaacgccctaacttaactggggatgaaattctattgcctttattttcagtctgtcgcggagaatgccgtgtgctgaagcactttcttgcggatgcgttactcaacgcattgcaatcttcaaaggatacgattgataagccattattatcggcttgttttgatactaaatacccttatgcgaaacagaatcctttcgagtgtaagttaacagaactcaagctagtagaactgaaaacagaaacttcttacaacaaaggtgctcaatttaaagaggaccgattaataggtcggtcatttactgatttattaccagttcacatgttgctgagtaagacacctttaaaagctcagtgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1906 - DNA, 12025 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtaacctgccggataggcagccaagaatagtacagcgcggctgaaatcatcattaaagcggtaacctgccggataggcagccaagaattagcgaattccgagcgaaggagatatacatatgcttaatccaatagagctttatgaagatgaatcgctagagagctgtttattaaggatcagtcagaataattgctatgattcatttcaggattttagcgatgaagtttggtttcaagtcaaagaagaggatcgtgaggttcgaggaactttccctgcaaccctaaatacggtaaatatctatcactctcacacatcaagtgacttaaagctcaaagcactaattaaaattgagcagtggcttgagataaataactcccctttattaaaaagcgccttgagcagatcaagcagtactttcttacgccaacattctgctgtttttagaaatggtgttgatataccaagaatcctgctcagaaaaaatggtattccagtatgccctgagtgcctaaaagagaacgaatacatacgtcaagaatggcacttcatcactcacgatgtatgcacaaggcataaaataggtctattacatcactgcccagagtgtaaagcctctatcaattatcaaaaaattgaaaacattacggtttgtcagtgtggattcaaattcagtgatcacttagctccgcaagcaaatagcaatgccttactcattgcacaatggcttaacggcgaaaatactaaattagctaatatttggggagaacaccaagcaatatcatctcgctttggtgtcttactttggtatatcaatagatataatctgacagatgatttttctacttcatttgtaaaatattcattgaattggccctcgaacttctattccgaactcgatgagcaaatagataaagctaaaacagttcagattaaaccatttaataagatattttttaatgagatatttgataacctgttattagattgccaacgcttacctacacgagaatttaaaacgaatcccatattaagtcatgtatatcagtactttctatctcgctaccaaattcaacctaactctgatgttttctcaatcttgctaagcccattagaggcatcgagcttgctttcttgcactaccgatcaaatctatcgtttatatgaattaggttttcttaaattaggcgttaggccaaaactgcatcaaaaaatagcaagtcaccaatcagtttttacactctcaagtattattctagtcaaactttcaaacatgcaatccagtcaagatgaattgcatcactacctttcagcgtggtaactaatggaatttacagatattctcatcattcaagatgtaaaggaacgcaacagagctttcaaggttgcatttgctcactactcttcagctatttttattgatgatcatgaagtcgaagcgattacatgcctacttaatttgtgtacgccaaaaacggaggattacctagacaaaactagcgcatctctgtttttaaataatcatgataatattcaaaagtgtcttgacgaacttaagtggttccatagtcacaatgttaaatatccagattgccgagttaaggggcaaagcattatttctttaccaatcgattcagtaagtaacaccataaacagtaatgtagttccttatcgattaggttggtcccatgacagtggaaaggttaactatactcattttctactctcttgctttaaatggagaggagtacaaacaactcttagtcaattattcataaccgacacgctgttttggttagacatcataaaaaaaatacaatgtaactggaccaagaaacaaactgagcaatttattcattccatacaaaaagaaatgcctgcaaaaacacttccagaagatattagcccatactcaaaacagatcttattcccatataaaaatgactatctaactttaactcctgttacttctaactcaattcaaacatggttagaacaccaatctaggaaacctaatgatattcgctggattaaacgagaaagtaagcaccctgctagtgtaggcgctttatcatcttctatcggtggataccatagcttactatcttcgctaccaagcacatcacaatcaccacactcgtatcacgataatatgactagcaaaactgaatgtagagaggctttttgtgcttcagctatcactgagaaaagtacgactgacgcattacaaaggctcatcagttctgaagtaagaatgaatgtgaaacatagaaaacaaatcagaaaatcagggattcatttcattagacaaaaaatagctctttggcttactcctctgattcgatggagagatcatatagataataaccagatacaaatcactaatgaccatccatcattagttaacctattcttgtcgtctcctattgctaattttcccgatttattaacaccattgcataatcacctaaatcaaactctaggaaataataaatacacaaaacgctttgcttatcaccctgatttaatgcctattttcaaatcacaaatttcatggattctgaataaactaacacaagatgaaaatataaatcagcagcccgttttaactagaacccaatttatccatcttaaaaatttaaggctatacaatggcaatgcgttaagctccccctatgtttgtggactaccttcactaactggtttttgggggtttatgcatgacttcgagcgaagattaaaaacaaagattgaagaaaacattcattttgaggctttcagcctatttgttcatcaatatgaattacaatcatctcctccgctctgtgaggcttcggatgtttataaaaaaagagaactatcacctgcaaaacgtttattaacgcaaccttcttattcttgtgatatgcgttttgacctcattatcaaagttcacactgaggttaatttaagcgatattagtcaacgtatgcaatctgcaatgcctgctcgttgtgttggtggtacgttacatcaaccttcgttacatgagagcttagaatggcttagaacctatacatcgtctgagcatttatttgaagaattagcttgccttcctaactctggtcgctggatatacccaccatcggaaacatttaacactccagatgaatttctttctatattgggaaatagcacacaccttgctatttgtaatggttattcatttcttgaagatcctacatatagagagaatgtgagccttaatcaacacgtattttgtgaacctttaattggattagcagagcaagtaatacctatagatatgagacttaaccgacaaaaacattatttttcaaatgctttttggtcgatcaatagtgatttcaattctattcttatttcaaaagcatgagtaaggatacgctatgaagctttgtaataacctgaactacactcgatcattgtcaccgggaaaggctgttttttattatgaaagtaaagatggtcaaatgaatcctattaagtgtgagcaaactcatttaagagcgcctaaagctggattttcagaggcttttaatagcgattactcaactaaaaacactgctccacaagatctctcctttagtaaccctcaatttattgaagagtgttatgttcctgttggtattgatgaaatcaaaattcgattttcattacgtatagaagcaaattcattacaaccagataaatgctctgatattcaaattagagaaatattgcaagcattcgccactaaatataaagaaaatggcggctatcaagaacttggtgaacgatacgcaaaaaacttactttctggtacttggctatggcggaatgagcataatctaggtacaagtatttcaataaaaacaacaagtaaccaagaatttaatatcaataatgcctttaagctatcaagaaaaacctccgctaaagataaaaaaacaatatcaaagttaggaagtgaaatcgcaagtgcattatctgaccctgaccattattactttgccgatataacagcaacaatcaatgtggctttctgccaagaaatttatcctagccaagagtttttagacactaaagaaaaagggaagccaagcaaagtatatgcaaaaacgtcacttcaaactggtgaaaaaaccattgcttttcatgcacaaaagattggagctgcaattcaacttatcgacgattggtgggctgacgatgccgatattccattaagagtaaatgagtttggtgctgatcatcacaatgtcatagccagaaggcacccctcacatcgtaatgacttttataccttaattcaaaacgctgataactactgcgcgcaactgaatgaaaattcagatattactgatgatatgcattacgttatggctgtattagtaaaaggaggactgtttcaaaaaagtgcttcttcaaaaaaaggaaagtagatgctcactcactattttagtattacgtatgtgcctgatgattgtgataatgagttattggcaggacgttgcatcgctgaatttcacaagtttatctctagtctaaggctgatagaaaacaactcttttgccattggcttcccaaattggtctgaacaaagtattgggaatgaatttgctattttttctgataactctgaattattaagtgccattaagtaccagccctatttcaatttaatgaagagtgaggaattattttctattacagacatcaagcctgtgccaaataatcttcctcaaataagattcatcagaaaccagtctattgggaaaatatttataggttcaaaaaaacgtagaatccagcgttcaatcacaagaaataataaagagcatacacctatatcaaatgaggacagagagtttgataccttccacaaagtgtcgtgctctagtaaaagtaaacagcaacaatttatccttcatattcaaaaagacatcaccccgagaactacagactctaacgatagctacaatagttatggcttagcgacaaatagtaaacatttaggcactgttcctgatttatcaaaaatacctttttattgcgaggacaaattatcaaataaagatcaatgacctttaataaggagatatagcatgtacgttcgtacactaaaacaatctcaagtaaaaaacattagcaaatttatgagcctgaagaatgattcgatcattcgtacagaatctatgcttgaatttgatatgtgctttcatcttgaatattctcctgatgttgttagctttgaatctcaacctcaaggctttcattacgaatatcaaggaaaacgcctcccctatactccagattttctcattacacattcatctggacagcaacaattactcgaggttaaacctctttctaaaacccaatgtcctgattttcaatcaaaattcatccaaaaacagcaagcagcccagaaattaaatctttcattaatccttattaccgaaaagcaaattagaacaggtcatttactcaacaacttcaaacttctgcatagatatgctggcctacatagtatatcggccactcaaaaatcaatcattaacctcatccagacagtaaataaaattcaaattaatcaaattgcacacaggttaaatatcagtaatggagaggtattagctggtgttttaagttggctatcaaaagggacactgcaaacggtttacacaaatgaaatgattaatggcaactctattgtatcgttaggtttatcaatggatatagaatttccatttactgatgaatttcaaaaaatattaactactcaatcctatccagctgaaatcactaatgataaaaaaacagaagtgcttacgccttctcttgattcatacgatgacgctataaaagcagaagtattgcgtcgtatttcttttcttaggtggataaagcctcgtttaaaaggtggatggacagaaaaaaatttaacacctcttcttaacgatgctgaaattgatttaaaagtgagcgcaccaaaatggcgaacccttgctgaatggcataagaattatcacaaaagtggggaaaaggtatcctctttaattccaaagcactcacataaaggtaataaaaatatgaatactgatagcgattttttgataacaaaagcaattaacgaaaaatatttaacactaaaccgatgctctatcagtcaaacttttaagtactattgtgatttagtaataattgaaaatcgctctatacctacaaagaaaataaaactggtcagtcaacgtactttttataaccgaatcaatgcactacctaaatatgatgtcgctttaaagcgttacggaaaacgatatgctgatattaattaccgcaccgtagataaaatgataacagcaacaaggcctttagaacgagtagaaatagaccacacgcctcttgacttaatcttgctcgatgacactttagagataccattaggtcgcccatacttaacaattttaatagatagctatagtaaatgcatcgtgggctacaatcttagcttcaggcctcctagctttgaatctattcgccatgctttttgtaatgcatgccttgataaatctttaattacacagcaatatcctcaccttcaacacgattggcctgttgcaggaaaaattgaaaatcttgttgttgataatggcgctgagttctggagtaatagcttagaagatagtttactgccttttgctaccaatattttatataacaaggttggtgaaccgtggatgaaacctcttgttgaaaagttttttgacctgttaaataaaggcttagtccattccctcccaggaacaactcgctcaagaatagagcaactgaaaggttataatcctaaaaaagatgcagcgattacattcagtttatttttagaactatttcatacgtggattatcgacatctatcacatgacttccgatacaagagagactgctgttccttattttaaatggcaagaaggagtaacggctttaccccctctcacctatacagatgaagaggctcaacaattacgaatagagcttggaatattaaatactcgaacggttcgtcttggaggtatttttcttcatggattacgttatgaatcagaagagttaagtgaatacagaaaaatttggggggctattgataagaataacctaacgctgaaaacaaaaaccgacccttcagatatatcacatatttttgtctatttaactaatgaatcacgctatattaaagttccttgcataacagatattagttatacatccggacttacgttatttcagcatcaaaccgctcaaaaattgcaaagaactaaaacaagattacaaatagatcatgaaaaactcgctgattcacgtatgtatgttgaaaatagaattgcggaagaagtggagaaaatcaaatctaataaaaaacgtactgcgaaaactacccatgcatcaaagatcgctcgacaccaagatattggtagtcatactcaaaagtcgattcaagtacctaatgagcaaagtgaaatcaaaaaactgaataaaaatgaacatgatgttttaaatggatgggatgaacaacatgatgatttagagggattctgatgcacactttatcttcgactcaaaaagagcaactcatcagctttaatcaatgctttattgagtatccaataattactcatatctactctatttttaatgatttacgaatgaatcaaggtttaggtgcagaaccacaatgtatgctcttacttggtgatactggctcaggaaaatcagcactcattaataactatctgttacgacaaccgccatcaaatttttccgcactcagttcattacccgttttacatacacgtatcccacgtagagtgaataacgaacaaaccatgtatcaactgttaactgacttaggacaatcaccttcaggatcgagacgtgcaaaacgctcagaaatcgctctcgccgaaggagtcgttcgagctttaaagcgtaaaaaaacagaactcattattattaatgagttccaagaactcatcgaattttcaagtgctaaagaacgtcagaatgtcgctaacacgcttaaatacattagtgaagaagctagagtatctattgtgttagttggtatgccctatgcagatattattgctgaggagcctcaatggggatctcgcttaacatggaaaacacaaatcgaatatttttcattaaaaaatgacatgaaaacctatgttcaattcctaaaaggcctagcaaatcgaatgggatatgatgaggtgccatcattgcatagcaaggagcttgctattccactgttttcaatttgtaggggtgagctaaggcaacttaaaaacttctgctctgatgcgatgctagagagctttaagcaaaacaaaaacacactaactcatgatgtattaagtgccactttcaagtacaaattcccaacgaagaaaaatccatttgaaatgaatgtagctgacgttccaattcaagaggtagagtcttattcaaagtataatctaaacgcaatgactgatgatgaacgtcttactgcaactaagtttcttgatgctatgtctttatcttcactgttgagtaagacttgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1907 - DNA, 12057 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgctccgccgaataggcagctaaaaagagtacagcgcggctgaaatcatcattaaagcggtgctccgccgaataggcagctaaaaagtagcgaattccgagcgaaggagatatacatatgagatttacagttcaaaccgagctgtttaaggatgaatcgcttgaaagttatttgcttagattagcagttgataatacgtacattgattacagtgagttcgctgacgtcattggccgctggctggtcgatcatgatcatgaattagaaggtgcatttccctgttctttagacttggtcaatctttatcatgctaaagacagtagtatttttagagtacgagcattaaaactctttgaaacccttacgagctttaaaccttcaacgttattatctcaatctcttttacgcacgaactataaattcgctcaatatacggcattaaaatttggttccagcttaataccaagagtaatgcttcgagaaaacaaagcaccaattcctatttgcccacaatgcataaaagagtcagcttatataaggcaatgctggcacttaaaaccttataccttttgccacaagcataatctaaggcttctcaatgaatgccctaaatgcggcgacgaaatcaattatatacgctacgaagtaattgaaaagtgtatatgcggagctgacctgtcaaaaatggcagcagtacacggagatattaagtatcagaaatgcattaaaaatttatttaacgaaatagaaggcgacaaatcatcagaaataggtaagttgctttggttttcaaagtataaaaatattgagttagatgatactgaattactcaatgagttttatgattattttgagttctggcccgctacctatctaagcgaacttgagcaatttgaattaggtggaattaacaagcaaataagacctttcaaccagactccagtaaatgatatttggaaggaacaaatagcactgtcaaaattggcgtccccatttaaacagaacaatgaagtattgaaggtgctctcagagtattttgttgatcttgtttatcgttatcctaaatctgaaacactaaaccctgcggacacattgcttacaaagttagaagcatcaattttgttgagaacgcctctggagcaagtgaatcgactattgaacgagaactatttacatcgagctattaagccaaaaaaacacgaaataatagagccgttcaaaccgcttttgtatttaaggcaagtcattgagctaatggaagtaagaggaatcaatcaagcatattctaatttatatacaacaacttggtgaaagcgatgctgactataaatgagttgttagaaattgctgatattgaggagcgcaacaaagctatcaggagcagacttaggccttttcatgagccattaaatgttgacggttctgaaaaagaaatactcattgtgctgttaaatttgggttacagctcaaaagaacaagttgatttgctagagcagaagtcagcacaacaatttcttaagggcgaggagctttttggaaagacgatctctgaagctgaatggatacatacgcacaatttaaagtatcctgacatcagagtaagtaagcaaacaattcgagcgacccttcctgaagatgtagaaggcgtttgcagtaaagacatcctagaaagcatagagttaggttggtcccataatgcaacgtttgtcggtaaagtaacaccattaattacagagtttaaatggcaaggtaaagtgacctgtcttataaatttactgttaagtgagagtgccttctgggttaacttgctcataacgttaggtgtctcaaaaaggtgggtgaaccgaactaaaatacaacttgcagatataacggcaaattcttttcctgaagaagtagatcgttactctccacagttaagattctataatcaacgaggctatgtatcagtcacaccagttacaaaccataaactactatctgaaatacaaaagcgttgttttaataaagaatttcgatgtcgtaaggtcaaacatccaagggcaacatgcgcaggtcacttgataacatcattgggcggatacgtttcagtattggcttactatcccgacagaggctttaatcgaaatattaaccagtatattgacgacaagactgatagtaacttttttaattctaagtacctcaacaatcataacttcttagaggctttaggtgagctggttttttcaccgaaacgagaaacgttgaagctaactcgcattgctagggtagcagcaataaagtcaataaggcagacactgtattggtggttagctaaagctacagattacaaaaagcatgcgaatatatcatcggatgtttcttctaacgcaaagttattcaaaaggtatttgaatcaaggcgaatcaaagaatgaattagcgagtgagcttagtaacttaattcatgagcagttagcacaagctaatcaaacaaagcagtttgcatatcactctaagctaatatcaccaattaaacggcaactccaattcttactaaaaaatagagctaatagtgaaacagagcagcaagaacaaagagttttttatcttcatctaaaacgacttagggttgaagatctggaaaccctgagttgtccatatttatgggggatgccttcaataatagcttttgctggttttgcccataaatttgaacttaatttaaaaaagctgggttttcataatattcgagtaatgggggtcgcttgttttgttcatttatatcaagtaacagctaaaacatcattgcctgcatattcacatttaaagaaagaaaaacaaagtgatcaattaaggcctacacgacctgctttagtttcagcgccaaagagtcaaatgctatttgatttggtgttaaggctttggaatggaggtaatgagtacaatttagaaagtttacctaatcctgtacagataagggaagcattacccactcgctatgcaggtggaactattttcccaacaatccgtaagctagaggagcgatttacgacctcacataaccttacagagttatttaactctctaagttttatgccagcaaaaggttgttggctatacccatctcaattcaaagttcattcattagatgaactccataaggcattagatacagatttgaatctaagaccagtagctattggctatcagtatcttgaagaaccaaagtatagggatggtggcataagtgaactgcattgctatgcagaaaacttacttggcctgactcgatgcactaacagtgtggatgttagagttggtggtgctcaaaggtttttaagagaggcgttttgggctcaaaaaacaactgattctgaagtgcttatggttaaatcacgtttcgagtttaaattatgaaaatacctacacatctatcttacatgagatcattgtcgccatcgccagcgttattcttttataaaacagacgagtccgattttaatcctattgaagtctttagcgaaggaatcaatggcaggatgtcaggttccgcagttgcatataataaagatggtaagcttaaaaatgtaacggctaatgatcttggtcacgcaaatttacatgcgagtgaatattgttatgtacctccaaaaattaaggaattttactgtaagttttcattgaccattgctcccaatagtctttctccctatatatgcaatgatcaagatttagtaatgtatttggaaaagttagctcaatgttatgctgagaaaggcggttatcaagagttagcaaccagatatgcaaagaatattttaaatggattgtggctatggcggaacaaaaagtctcctaaagttgatatttctgtgtatgactttttgagtgaacaagaggttgctaatacagcgggtgttcaatcgctgtcttgggatggaaactgggggaaatatcacgatgagctacaaaaattatctaagataattgctcaggcacttcataataatgaagcatgcgaactggaagttgttgcaacaattcgcaatcgctttatgcaagaaatatatccaagtcagcttttacctgaagaaaacaaagtccacaagcaattagctacaacaagggttgaagatggctctgaaactacctgtttgggtcgttttaaagtgggagcagcaatacagataattgatgattggcatggtggagataagcctctaagggtgagtagttatggttctgtaccagaaaggttagtcgcattacgaactccttcaaacaaaaaagatgtttattcactcttacctaaaattatcgattacattaactttttagaatctaataacctcggtgaaaatgagacttcaaatgaaattaattatctaatggctatgttggtaaaaggtgatgtattaggcatgggatcggagaaaaaaagcaaatgagaagttatttttatatcacttatttgcctgaaaatgtgaacaatgaactgcttgcagctcgatgtgtcaatgtgctacatggttttgttgctaaagaagatgttgtcgatattggtattagttttccggcgtggagtgaacatacagtagggaatcaacttgcctttgtatcgacaagtaaaagtaagctgacaaggatacttcatcacaattatttctcaatgatgaaagaagatggtcttttttatatttctaacattgagccagtgccaacagggttaaaagagattcaatttttaagaaataatacaatcgcaaaaacaacgcttggtgaaaaacgacgcagaaataaaagagcgtttgaaagggctgaagctagaggagacgaatacgcgcctgttcaaaataatcaagctcaattcatccacaattatcatattctcaactgtacaagtggtagtaaaaatatgtcattccctctttatattcaaaagagggaagatacctctcaccaaaactgtgactttaatcactacggcctcgcttctaataagttatatagtggaactgtaccagagtttaactttgaccaataacctttaataaggagatatagcatgcctatatcgcgtcgaaatattagtcactcaagagttaaaaatctttctaagctctctaacttcaaaaatcctaacagtgaaaaacgaattgctgagtctcacaatgaatttttagctgctcattttctgaattattttcctattgttaagtctttccagttccagccattagcttttgattatgaaaatcaagatgaaatacattcatacactagtgattttctagtagaactcgagacaggaaaatttgtttatatagaagtaaaagaagagaaagcattatattcagaggactttaaatcaatttttgaagctaaaagagcagctgcaagacagttaaataaagaattaattcttattacagagaaccagtacaacatccctcctcgaatagacaatataaaatctcttttgaacgtgggaggtttttgggctgacgacaatatatctaacctagtggttggtatagtaaaaaaaagtgaaacgatcgatatagagggtattgcttatcatttaagtcaattttccagagaggaaatctttaaagcaatacgtatattgattctaaaacgagagatatattttgatttatctagttctgaactcacatttgattctaaagtatcaagcgatactacgcaatacaataatgcagagtttttcattgatgagttcgttgagtttgatttcaacaaaaagccggcaaaaaatgaggtgaaattatttccaaaagatatggatattttccctgaaaagtataaacaagaagctctagctaagaagcgctatattaaatgggttgaacgtaagctcgtaggaaagtggacagaaaagaatataaatttacttttacatgaaataccaaattttggggttaatcctacaccgtgttcgagaagtataatgcgctggaaagatgcgtacacgaaaggaagtcgaaaactaatagctcttgttcccaagcatgtgtctaaaggcaggactattgctgtcagtgaacatgacgagtttatcgaacatggaatcagtaactatctaactgaactaagattatcaattaatgaatgttataagaaatatgaaacacaactgcgaactaataccgacttagaacctgtcagttataatacttttaagttgcgcatagataaattgcctaagtacgatgttaaatgtgcgagagaagggaaagcagctgctgatatagactttaacaattatgacgaacattgcccacccaaaaggctttacgaacaagtagaaatagaccatacggtattgactgttattttgcttgattctgagtatttatttccgattggtaggccaaccttaaccgttttaattgataaattaagtcattgtatttgtggtttttatgttagctatgaacctccatcttacaatagtgctaggcaggcaattcttcacagtatcaagcctaaagattatattaaaaacttatatccttcgataaaaaacgagtggaactgtcacggaaaaattgaaaatttgatagtcgataacggtgccgaattttggagtaccaatttagaggttgcttgcgagaattggatgaacattcagtttaatcctgtagggaaaccttggaagaaggcatttgttgagaggtttattggaactacttgccgtgaatttactgcacggtttaaaggaaaaacattttctaatattttagagaaaatgaaatacgatcctaaaaaagatgctgtcatgaggtttgatttgtttcttgagctatttcataagtggattatcgatgattatcatcaaagagcagacagtagattcaaatacattccaaatgaactctggcagaaaaattatcttaaaagcccagttttaaagttagatcaagctgaggaagaaaaactggaaaatgacttcctttgtactgaatggcgtgagtggcgaaagggtggaatacatatatttaatcttcgttatgatagcgaatatctttcaaaggtgagaaaacagtacgttaaggaaggaaatgataaaaaacagaagattttagttaaatactctcctgaaaatattaatactattagaatttacattgaggacttaggtaaatacatcgaagtcccttgtgtggatagcgtaggttatacaaaaggtctatccctatttaatcatcaggtaaaccttagagttcatcgaacttacattaaatcgaaaattgatgtcgtgtcattagcagaagtaagaaaatatgttaatgatcgtgttgaagaagaagaggagtttgtagaaaagggtagaaagaagaacctttcggccaataaagcaagatcgaggtataaatcaataaacagtaaaaacagtataagtaaaaaagacaataaatttgaagatattgaaaaaagtgaagatgcttcacctgaagattggaataacttcgctgaaggtttggagggtttctaatggctagactttctacagagcaatgcgttttacttaaaaatttcaaaaatgaatttattccccatgctatagctgaaactattcatgacgattttgaacgtttgagagagaatcataggttaggcggcgaacagttgtgcatgttgatttatggcgacgaaggttccggaaaaaaatctattataaaggcttatgaagataaatgtaaaaatgaagaggttattgatgaagggaaatttaaagtacccgttttattttctgaagtgaaactgccaataactgtgaactcattctttacgcaacttcttatagatttaggtgagttcgctggggcatatagaaaagctgagggtaagaataagaataaggatatgagtaaacagctagaagatatattgaaagaacgccttataaaacttgaaactgaactcattataatttacaaatttgaactgttattgcaatttgataaaaaaatgaggatagatgagcttgcaaaccaattaaaaagcatggctcaagagcttggaatccctttggtgatcatcggaatgccatgtatcaaaaggttgatgttaacttcaggatggagaagctatattcatatttgtcggttaattccatatttcaaattaagtaatgaacttgaaaaggcattttacgttaaggttatcaaggggctttctaatagagcccaaaaactattttcttttgcaccaaaattagaggataaaagcatttcttatcctctatttgctgtttcgtcaggatgttttagaacaattagaaactatactaataaagctgtattactagcagtaaatgaaggtgctgaagaattgacaatagagcatttttctaaagttttcgagagggataatgagtacccgttattaggaaaggttgattcaacgaatgatgattccatgaaaaagttgaatgaaagtattaaagatgaaagggacaaaagagattctattaacccttttaaaatatctgtagataaactaatggtcaatgaggtgatagattatgcaacttataaatatgacgaagagtctgcttcagaagtaaaatttgacactaggtttgccgataaaatttcaataaatgatttattgagaaaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 1908 - DNA, 624 bp, Vibrio diazotrophicus strain 60.6F
atgtacgttcgcaatcttcgaaaaccttcagcaaacaaaaacgtttataagtttgttagtgtaaaaaatggctgcaatatcatgtgcgaaagctcattggaatatgattgttgctactatttagaatattcggatgatgttgttcgttaccagtcacagccgaaaggttaccgttttccttatcaaggtaaagaacatccatacacccctgattttttagtccataagaaagatggaacgtcttatctcctcgaagtaaaaccactatcaaaaacattcagctccgaattccaagatgtatttcgccaaaaacaaatcatggcaagtgaattgggggcacctctattactcgtgacagaccgccaaattcggaacgatgtgcaccttaataatttaaaactcgtacatcgttatagcggttgtatcggaaattctagccatttggaaagtgtttggtcagccgttaatcaatcctcatcgatttgtattaaggcgttatctgcaattttgaatctaaccattggtgaagtttttgcttccgtactacgtcttattggtttaggaaaagccaaaacaaaattggatgttttactggatgaaaattctttaatttcggtggcttaa

SEQ ID NO: 1909 - DNA, 1908 bp, Vibrio diazotrophicus strain 60.6F
atgtcttttgggccatttgaagatgagttcggttcaataacaaatgacgttcagcaacaatatgaggcaagccctgaagctaagctatctcggctgaagtattcacctcttgaaaccaccaaggttattgagcgagatctatcttcttttcctgaagagcaaaaactaaaagcgctggaacgttataaattaatctctttgattgctaaggagataaatggtggctggacacctaaaaatcttatcccattgatagataagcatatagaaacacttaatataccgaagcccagtgatcgtacagtaaaacgttggtataaagctttttgtgaaagcgatggtgatattaagagtttggttgatagtcatcacttaaagggtaaccggcagcccagaattgaagacgatgaaccgttttttatagaggctgttgaacgttttttagatgctgttcgtccttcttactctaaggcttatcaggtttactgtgaccgaattgaaattgaaaatagcactatcgtttcaggtaagatagcgaaagtcagctatgaagctttcaagaaacggctcaaaaaactccctccatataccgtcgctctcaagcgtcatggtaaatattacgccgacaaactgtttaactactatgaagcagtcaagatgcctacgcgtatcctggaaagagtagagattgaccatactcctctagatttaatcttgctcgatgatgagctgcttgtgccgttggggagagcctatttaactttattagttgatgtgtttagtggctgtataattggatttcatctcggtttcaaagcaccaagttatactgcggtttcaaaggcaattatccattcagttaaatcaaaggaatacgttaatgaattgccaattggattgtcgaaccaatggatttgtcatggaaaaatagaaaatcttgttgttgataacggtgctgagttttggtcgaaaagtttagaccaagcatgtattgaggctggtatcaacataatctataacaaagttcgtaagccttggttaaagccctttgttgagagaaaatttggtgaactaattcaaggtattgtgggatgggttcctggcagaacattttccaatgttcttgagaaagaagattatgaccctcaaaaagatgctgtgatgcgttttagtgttttcgttgaagagttacatcgctggattattgatgtgcataacgcttcagcggatagtcgacatacgcggatacctaattatcattggcaaaagagtgaagaagtattgccacctcctgctttgactgagcgtgacgagatacaattccgtgtaattatggggatggttcataaaggggcattaaccagtaaagggataaaatttaagcacttaatgtacgacaatgtggcgttagaacactatcgtaaacagtatccgcaatccaaagatagcaggataaaaacggtcaagattgaccctgatgacttatctcgtatctttgtgtttcttgaagaaaaaaagggttatatagaagtcccttgtaagtatgacccacttggttacaccaaaaaacttagcctttgtgagcatttaagaacggtaaaagtacaccgtgattttataaaaggacaagttgattcattatcactagctaaagcacgtcaggctttgcatgagagaattaagcaggaacatgaaaacttacgtcagatgtcgttacctcatcgtgctaaaaaggctaaaaacggtaagaaaatggctgaactggctggtgttaacagcgatagccctaaatccataacaaccgattatccgatagaagacaccatacaacttcacgaatctacacctgtcgatgatctccaatcactttggaataagcgcagggcattaaggaagtcgggcaaatga

SEQ ID NO: 1910 - DNA, 987 bp, Vibrio diazotrophicus strain 60.6F
atgacatcgcttcagccaacgaataatgacgtcgatgtattactagctgagttccatcagtcattcgtcgtttatccggatgttgaaaaggtttttgaaggtttagattggattgttcgtcgcagccagttcggtaagtttgcgccttctatgctaattacaggcgggacaggtgcgggaaagacttcagtggttgaaatctatttgaacaaccatttttcctcttcagaagtgttaatcacaagagtcaggccaagttttgttgaaacattaatttgggcgatcgaaaagctgaatgttccttacaacagtcggtcgaaacggtctgagattggcctacaagattatttcatcaatagtgttaagaaatctaagcttaagctgttggttatagaagaagctcaagaattgtttgagtgcgcatctcctaaagaaaggcaaaaaatacgtgaccgattaaagatgatcagtgatgaatgtcgattacctatcgtctttattggtattcctaccgccaaacttatcttggaagattcacaatgggacagacgaattatggtgaagcgagacttgccatatatccgaataacgaacgaagagtctttagatgtctatattgccttacttgaggggcttgaaaagaccttacctatttcagtcgctccggaactgactgatatggacatggctatgcgtttattagctgccagtagagggatgctcggtttaatcaaagaacttgtaggttatgcgtttgaactggctttactcgaaggtaaacgtcagattactcaaaacgaatttgttcaggcatttaaatctatttttggtcccgatattagtaacccatttgagattgaactggataaattactaatcccgcagattattgagtatgaaggctatcttttggactcagatagtggggatatcaagtttactcatcagatatttgaagacataccattaacagaattactacgttaa

SEQ ID NO: 1911 - DNA, 1212 bp, Vibrio diazotrophicus strain 60.6F
atggatacggacatcgaagtttactctgatgaatctctcgaaagctttttactacgcttaagtaagtttcaaggctacgagcggtttgctcatttcgctgaagacatttggcaaactacgttattgcaacatgaggctattcccggcgcatttcctttcgagttaagtcgaatcaacatctataaagctcaaacaacgagccaaatgcgagttcgagtacttatagatttggaaaagcggctgaaatttaacgactttggcgttctacggctatcgcttgctcattcgaaagcaagtttctctccagattataaagcggtaaatcgctatggtgctgattatcctcaagcctttcttagaaaaaacttcacacctgtttgccctaaatgcctagacgaagctgcttatattcgtcagttgtggcatttcattccctaccaagtttgccataaacaccacagccaactcgctcaacgatgccccgaatgcggaaaattattgaactaccaatcgtcagagctaatagagaattgtgaatgtggtttttccttacttaatggcgaatcagagaaggaaagctgttctactttatttgttgcacagtggctagcaggggagaaacccgtagaatcaggattaatgagtcaggaactcactcaatcaagtcggtttggatttctgctttggtatatcaaccgatatggtgaacttgatgatattagttttgatggctttgttgagtgttgtaaatcttggccgaacaagctcaataccgatttagattcaattgtgcagaaggctgacatagtgcgaatccagccttggaacaaaatctacttcagtgaagtgtttggtgacttgttgaaagagtgtcgcagcctaccaagccgtgatcttagtaaaaatccggtgctgaaaaatgtagttctatatttcagagctttaatcaccaataatcctaaagtgaaatcagcaaacataggtgatgtattattaagccctttagaagcttctacattgctttcatgtaccacagacgaaatatatcgcctgtaccagtttggacagcttaaagctcaacacacgcccaagttgcagagtaaaatagaaaaccatcactctgttttcactcttcgtagcattatcgagctcaagttatccagtatgtgtagtgaaactgatggtttaaatcattatttgccagagtggtaa

SEQ ID NO: 1912 - DNA, 2091 bp, Vibrio diazotrophicus strain 60.6F
atgacaactttgcaagatttaatcgatattgaagactctaagctccgatttatagagataaaaaaagcgtttatgccgtatacacgaccagtagaagttgatgggagtgaaaaacaggcattaattgttttactcaatctttcattgagtaaaccggaagtgaaagactggctcgattttcctcgcgctttggactatttcgccgattcagataacttatcggcggctgaacaagaaattcagtggtttcatacccataacctcaaattcccagattgccgagtatcagagcagcgaatcatagctacacctctgtacactgagactccgacactcacgagtcagtcattaaacagagcttatggctgggcgcacaattccgctgtttataaacatactatctggttattaaatgaattccggtggcgtggaagagtggaaaatctgcttaatcttatttgtggtggtgatgatttttggctggaacttttagctgatatgggattaaaacctaaagcacaaatacagcttaaagatctaattgaacatcagttaccgttgactcattttcccgacgaagtgaaccgctacagcaagcagctccgtttcccttggaggggggattacctatcagtaacccctgtggttagccatgctatacagcagcaactctctgttttgtctcgtcaaggtgaatgttctcttcgctttaaaacaatgacctatccaaattcagctagtattggaaatttatgtggttcactgggaggatatataaatgtactcaattatccgattgacgtaattgcgaatcgacatcaaacactcggtgcaagccgcagtagaaccaagcgctactttgatgattttcagttaacgtcaaaaagtacctgtagtgtattggctcatctgacaggttttgaacaacctcaaatgcgcaaagcgcagaaacatgttcgccagtatcaactgaaaattatacgtaaacaaatcgctttatggttactcccgcttattgaattacgggataattcagtcactgatccaattggcttttatgatgaaccagatgatgaactggcgaagcgattcttgaccatcaatgagcttgattttatagagctcacaaccagcttaaatcagcgcttgaatatagctttacagaacaaccgctttgcttctcgttttgcctaccatcccaaactgatgcgtgtgttaaaaacagagcttatttgggtgctaactcagctaagtcaacctgaaccagaacctcctactgtttctgatagtaaagtgcagtatctttacctttcatctatgagagtatttgatgctgctgcaatgagttgcccgtacttatctggtgcgccttcattaacggcggtgtggggatttgttcatcgttaccagagagagctacaagatttgctatctgatggagaagggcaattcgagtttaaagattttgctttttttattcgtgatgaatccgtacaaaccagcgcaaagctcaccgaacccagtgtaatagcaaaagctcggagtatttcacaagttaagcgaaccacgatcattcgtgaagattgctcggatttaatattcgatattgtaattgcaatagaaagtgaccaacgaatttcagattaccaaagccagtttaaagctgcattaccaactaatttcgctggaggggccttgtttcaacccgagattaattcagggattaattggttaagaacctttgtaagtaagtcagaattgttccaagcggtgaaaggtttaccgggctatggtacttggttgtcaccagattcttttcaacctcaaaatctggctgagttacaagagtgtttaacgattgatagttcgctaattcctgtatcaaatggctttcattttctagggtcgccacaggaacggaagggggcattgacgaaactgcattgttatgcggaaaacaacattgctttagctaaacgaaccaatccaatagaagtaagatttgccggtagtgatcacttttttgagcaggtgttttggtcgctggaagtgacagagcagactatccttataaaaaacaaaaggatttag

SEQ ID NO: 1913 - DNA, 1038 bp, Vibrio diazotrophicus strain 60.6F
atggaactctgcagtcagttaaattatgttcgctcgttatcacctggcagagcatatttttattatcttgatgaagataataagatgcgtccacttcagatagacaggactcatttacgagcacccaaaagtggctattcagaagctttctcgggtaatttcaaatctaaaaatatagctccgcaagatctttcctattcaaacccacaattcattgaagagtgttacgtgccgcccggagtaaatgatatctattgtgctttctcgttaagagttcgagcgaattcattatcaccagaagtatgtgttgataatgaggttcgagacatactctgtaattttgcggcactgtataaagaattaggaggatatcgggagctggcaaggcgttatgccaaaaatattttgatgggtacgtgggtttggcgtaaccgagagtgcagaaatataagggttgaagttaaaacagaagataaagagtgggtaattactgacgcaaggtttttagattggtatggctcgtgggagaaggattcacaattagccttagatgaatttactgactatttgtctcaagctttgtcggatagaacctgctatttcaatatggatattaaagcgaagctcactgtaggttggggcgatgaggtttacccaagccaagaattcttagatgtgaaagaagcaggaaagccaagcaaactgttggcaaaggtaaccgtcaatggcgaagagtcagcagcctttcattcgcagaaagttggagcggcgattcaacgaatcgatgactggtgggatgaaaatgccgataagccgcttcgcgttaatgaatatggagcagacaaagaatatgcaatagcaaggcgacatagttcacgacaccgggacttctactcattgattgcacacactgaaagctatgttgaattgatgctagaaacgaatctgatctcagatgatgtccactttatcatggcagtactaactaaaggtggagtgttcagcggtgcaagcaagaaaagcaagaaggatgagtaa

SEQ ID NO: 1914 - DNA, 612 bp, Vibrio diazotrophicus strain 60.6F
atggaatctcgctattatttttctattcgatatattcctgaacatgttgacaatgaactattggcaggtcggtgtatttcgaatatgcatgggtttctttctcacgaacgcaacacgcaattcaaaaatagtgtgggtatttgtttccccctttggaatgaacaaacggtcggtaatgtgattacttttgtctcgactaatgaaagtatcctcactggcctatcataccaaccttacttctctacaatgatgaacgagaacctctttgaaatctcaggtattaggattgttcctgatgacgctaaggacgttcgatttgtattcaataaaacaattcaaaagatattcaatggttcgaaaaagcgaagaattaaacgagcgatgaaacgtgctgaagaatttggtcatactttcacacctatatcagttgaagtacgggagtttgagttgttccacgagattcctataaacagcaaatcatcaggacgtgatttcgttctacatatacaacgccaaaatccagtggaagcggaaataggacagggatttaatggctatggttttgcatcaaatcagctatggcgaagaacagtcccacttatcttgttttga

SEQ ID NO: 1915 - DNA, 28 bp, Vibrio diazotrophicus strain 60.6F
gtgttccgccgaataggcggctaagaaa

SEQ ID NO: 1916 - DNA, 510 bp, Vibrio diazotrophicus strain 60.6F
  misc_feature (251)..(260): n is a, c, g, or t
tgtcgctgaaaccataagatgtcctaacgctccattacaaatcaatccattaccaacacagtaaaaccatatagtgtcctaagatgaaagcataacgtgtcctattttctgcttcggtttaacactgaggaaaattgtgaaagaaaactacttactgttttatgcagaagtgcagtagagaaaaccacacctcttggtgatcacacggctaactatcacagcgactaaccatgccaatgtaacaaggtttnnnnnnnnnncatcatccgaatattctaaatagtagcaacaatcatattccaatgagctttcgcacatgatattgcagccattttttacactaacaaacttataaacgtttttgtttgctgaaggttttcgaagattgcgaacgtacataacatgtcctttttcgttgtaaaaaaacaaccaaaataagtttaggacactttatgggttttattgggacattttatggtttttttgggacgctttatgatttcagcgaca

SEQ ID NO: 1917 - protein, 207 aa, Vibrio diazotrophicus strain 60.6F
MYVRNLRKPSANKNVYKFVSVKNGCNIMCESSLEYDCCYYLEYSDDVVRYQSQPKGYRFPYQGKEHPYTPDFLVHKKDGTSYLLEVKPLSKTFSSEFQDVFRQKQIMASELGAPLLLVTDRQIRNDVHLNNLKLVHRYSGCIGNSSHLESVWSAVNQSSSICIKALSAILNLTIGEVFASVLRLIGLGKAKTKLDVLLDENSLISVA

SEQ ID NO: 1918 - protein, 635 aa, Vibrio diazotrophicus strain 60.6F
MSFGPFEDEFGSITNDVQQQYEASPEAKLSRLKYSPLETTKVIERDLSSFPEEQKLKALERYKLISLIAKEINGGWTPKNLIPLIDKHIETLNIPKPSDRTVKRWYKAFCESDGDIKSLVDSHHLKGNRQPRIEDDEPFFIEAVERFLDAVRPSYSKAYQVYCDRIEIENSTIVSGKIAKVSYEAFKKRLKKLPPYTVALKRHGKYYADKLFNYYEAVKMPTRILERVEIDHTPLDLILLDDELLVPLGRAYLTLLVDVFSGCIIGFHLGFKAPSYTAVSKAIIHSVKSKEYVNELPIGLSNQWICHGKIENLVVDNGAEFWSKSLDQACIEAGINIIYNKVRKPWLKPFVERKFGELIQGIVGWVPGRTFSNVLEKEDYDPQKDAVMRFSVFVEELHRWIIDVHNASADSRHTRIPNYHWQKSEEVLPPPALTERDEIQFRVIMGMVHKGALTSKGIKFKHLMYDNVALEHYRKQYPQSKDSRIKTVKIDPDDLSRIFVFLEEKKGYIEVPCKYDPLGYTKKLSLCEHLRTVKVHRDFIKGQVDSLSLAKARQALHERIKQEHENLRQMSLPHRAKKAKNGKKMAELAGVNSDSPKSITTDYPIEDTIQLHESTPVDDLQSLWNKRRALRKSGK

SEQ ID NO: 1919 - protein, 328 aa, Vibrio diazotrophicus strain 60.6F
MTSLQPTNNDVDVLLAEFHQSFVVYPDVEKVFEGLDWIVRRSQFGKFAPSMLITGGTGAGKTSVVEIYLNNHFSSSEVLITRVRPSFVETLIWAIEKLNVPYNSRSKRSEIGLQDYFINSVKKSKLKLLVIEEAQELFECASPKERQKIRDRLKMISDECRLPIVFIGIPTAKLILEDSQWDRRIMVKRDLPYIRITNEESLDVYIALLEGLEKTLPISVAPELTDMDMAMRLLAASRGMLGLIKELVGYAFELALLEGKRQITQNEFVQAFKSIFGPDISNPFEIELDKLLIPQIIEYEGYLLDSDSGDIKFTHQIFEDIPLTELLR

SEQ ID NO: 1920 - protein, 403 aa, Vibrio diazotrophicus strain 60.6F
MDTDIEVYSDESLESFLLRLSKFQGYERFAHFAEDIWQTTLLQHEAIPGAFPFELSRINIYKAQTTSQMRVRVLIDLEKRLKFNDFGVLRLSLAHSKASFSPDYKAVNRYGADYPQAFLRKNFTPVCPKCLDEAAYIRQLWHFIPYQVCHKHHSQLAQRCPECGKLLNYQSSELIENCECGFSLLNGESEKESCSTLFVAQWLAGEKPVESGLMSQELTQSSRFGFLLWYINRYGELDDISFDGFVECCKSWPNKLNTDLDSIVQKADIVRIQPWNKIYFSEVFGDLLKECRSLPSRDLSKNPVLKNVVLYFRALITNNPKVKSANIGDVLLSPLEASTLLSCTTDEIYRLYQFGQLKAQHTPKLQSKIENHHSVFTLRSIIELKLSSMCSETDGLNHYLPEW

SEQ ID NO: 1921 - protein, 696 aa, Vibrio diazotrophicus strain 60.6F
MTTLQDLIDIEDSKLRFIEIKKAFMPYTRPVEVDGSEKQALIVLLNLSLSKPEVKDWLDFPRALDYFADSDNLSAAEQEIQWFHTHNLKFPDCRVSEQRIIATPLYTETPTLTSQSLNRAYGWAHNSAVYKHTIWLLNEFRWRGRVENLLNLICGGDDFWLELLADMGLKPKAQIQLKDLIEHQLPLTHFPDEVNRYSKQLRFPWRGDYLSVTPVVSHAIQQQLSVLSRQGECSLRFKTMTYPNSASIGNLCGSLGGYINVLNYPIDVIANRHQTLGASRSRTKRYFDDFQLTSKSTCSVLAHLTGFEQPQMRKAQKHVRQYQLKIIRKQIALWLLPLIELRDNSVTDPIGFYDEPDDELAKRFLTINELDFIELTTSLNQRLNIALQNNRFASRFAYHPKLMRVLKTELIWVLTQLSQPEPEPPTVSDSKVQYLYLSSMRVFDAAAMSCPYLSGAPSLTAVWGFVHRYQRELQDLLSDGEGQFEFKDFAFFIRDESVQTSAKLTEPSVIAKARSISQVKRTTIIREDCSDLIFDIVIAIESDQRISDYQSQFKAALPTNFAGGALFQPEINSGINWLRTFVSKSELFQAVKGLPGYGTWLSPDSFQPQNLAELQECLTIDSSLIPVSNGFHFLGSPQERKGALTKLHCYAENNIALAKRTNPIEVRFAGSDHFFEQVFWSLEVTEQTILIKNKRI

SEQ ID NO: 1922 - protein, 345 aa, Vibrio diazotrophicus strain 60.6F
MELCSQLNYVRSLSPGRAYFYYLDEDNKMRPLQIDRTHLRAPKSGYSEAFSGNFKSKNIAPQDLSYSNPQFIEECYVPPGVNDIYCAFSLRVRANSLSPEVCVDNEVRDILCNFAALYKELGGYRELARRYAKNILMGTWVWRNRECRNIRVEVKTEDKEWVITDARFLDWYGSWEKDSQLALDEFTDYLSQALSDRTCYFNMDIKAKLTVGWGDEVYPSQEFLDVKEAGKPSKLLAKVTVNGEESAAFHSQKVGAAIQRIDDWWDENADKPLRVNEYGADKEYAIARRHSSRHRDFYSLIAHTESYVELMLETNLISDDVHFIMAVLTKGGVFSGASKKSKKDE

SEQ ID NO: 1923 - protein, 203 aa, Vibrio diazotrophicus strain 60.6F
MESRYYFSIRYIPEHVDNELLAGRCISNMHGFLSHERNTQFKNSVGICFPLWNEQTVGNVITFVSTNESILTGLSYQPYFSTMMNENLFEISGIRIVPDDAKDVRFVFNKTIQKIFNGSKKRRIKRAMKRAEEFGHTFTPISVEVREFELFHEIPINSKSSGRDFVLHIQRQNPVEAEIGQGFNGYGFASNQLWRRTVPLILF

SEQ ID NO: 1924 - DNA, 624 bp, Vibrio sp. 16
atgttcgatcaaaccaagaagtcatctcacgtgcacaacatctgtaagttcatgagcttgaagaatgatgcagttgttcgcactctgtccattttagagtttgatttctgttttcacctcgaatacaacgcagacatcaaaacctttacgtcccaaccttttggtttccactatcaattcaataatcgaaagtgccgatatacgcccgattttttggcgacagatcacgatgaacattcaactttcttcgaagtaaaacactctagccagattctcaaacctgatttcagggaacgatttaaagagaaacaaagagttgcgttcaatgagtttaacagacgcttggttttagttactgagaagcaaattagaatgggaccaactttagataacttcaagctactacatcgttactccggattgcggaccgtgactgagtttcaaaagttagtgttggcgtttattcaacgtaaacaaatggtgaagttacaagaggtgtctttgtatttcggtttatcggagcaggacacacttatctctactctaccttggatctcttcggggcaagttaaaacaaacctcaataatattggctttggcctcgaaacttacgtttggtgttaa

SEQ ID NO: 1925 - DNA, 1866 bp, Vibrio sp. 16
atgccgtcggactccaataacatatttgggttctttgatgagtttgaagcttcagagggagagtcgcagcagcttccaatagagttaattcaagaacctattgaaatcttttccactattgatactcaatcaccaaaggtacagcaagaagttatccgccgtatcaaaatcatcgatttcgtagagaggcgcctaaaggggggatggaccgagaaaaacttgaatcctatcttaagtctcattgaaccagaattaaagcttactcccccgagttggcgaactttagcaacttggaaaaaatcttactttgaagcgggtaaagacccatgtgcacttattccgaagcatacgtttaagggcaaccgccaaaaagaaatggattcgcaatccttgattgatgaggcagttcagaacgtatacctgacacgtgaacgacttagcgtggcagaagcataccgatactataagagtcgagtgattcaaataaatcgcgggattgtcgaggggaaaatcaaaccaatttcagatcgttctttttataatcgaatacacgacttacctccatatgaggtcgcgatcgcaaggtttggcaaacgatatgcggatcgggagtttcggtcagttggtcaacaggtagccgcgactaaaccaatggagtttgtcgaaattgaccatactccagttccagtgattttgatcgatgatgagttagagattcctttaggtcggccctatctgacgatgctatatgaccgcttcagtaaatgtatcgtaggatgcagtatcaactttagagagcctagttttgactctgtcagaaaggcgctattgaattcgctactagataagagttgggtaaagcaaaggtatccttctattgataatgaatggccttgccacggcaagattgactgtttagttgtcgataatggtgctgagttttggagtaaaagcttggaagattcgttacggcctctggtatcagacatccaatacagtcaagccgctaaaccttggcgaaagtcagggatcgaaaagctgtttgatcagatgaacaaagggttagtgaacgcactgcctggaaaaacgttcaccaatcctactcagctacaagattacaacccaaagaaggatgcggtggttagagtttccgtgtttcttgagctacttcataaatggattgtcgattattaccatatggcacctgattcaagagaacgtgacattccataccacaagtggaaccaatcggaatggactccctcttactacagtggtgttgagaaggagcagttgagagttgagctaggtttgcttagacacagaaccattggagtagcagggatcaggcttcataatctccactatcagtcctcagaacttattgaataccgtaaatattgggcgtccaacaatggcaaaaagctgtttgttaagaccaaaacagacccttctgatatcagctctattcatgtttatctagaatcggaaaagaggtacataaaagttccagcggtagacaacaccggatatacaaaggggctgtcgctttttgaacacgagcgaatacaaaaagtacgccggctcaatactaagcagcttactgatgatgaggcgcttgcggatacattcctgtatatgaagaaacgtattcaggaagaaaccgatagattccgcggtgcaaaaagcaataaggctagcttgcctaaaacgggcaatacttcgaaattagcaaagtttaatgatgtcggatctgagggaccaagctcaatcaacgtgattcctgttacgcacaaatctgaggttgtttccgatgcctcagagtacttagatgacgatgattttgaagatattgaagggtattaa

SEQ ID NO: 1926 - DNA, 1116 bp, Vibrio sp. 16
atgacgatgattttgaagatattgaagggtattaatttgaatttaacgccaaagcagcttgagcagctaaagtcctttgaaaccagctttatcgagtatcccgcgataactgaaatctactctatctttgatcaacttcgtttcaatcactctttaggtggtgaaccagagtctttcttgttaactggtgaggctggaagtggaaagacggctttgatcaacaactacttatcacgctttcaatcgggttcaacttgggaaaaacagccagtgttaagcactagagtgccaagtcgtatcaatgaacagaatacgctgacccaatttttggttgatttagattgtaaatccggaggaagaggtattcggcgccgtaatgaaattgcgcttggcgaagcggttgtaaagcaacttaaacgtaaatctgttgagctgattattgttaatgaaattcaagagctggttgagttttcaaccgcagaacagagacaagttattgccaacacattcaaatatataagtgaagaagcaagagtctcgtttgtgctagtgggtatgccttatgctgatgtgatagcgacagaaccacagtggaactcgcggctaagctggaggagaaagatagattatttcaaattgttgaaagcgaagagtcattcgaatagaacggtatcttatgggtttgacttagaacaaaaaaaacattttgccagatttgtcgcgggtttgagtgcgagaatgggctttgatgaaccgccagtgcttacaaaaaatgaagtgttatatcctttgttcgttatgtgtagaggggagtgccgagcgttgaagcacttcttgaaagatgcactacttatgagtttcaatgagaacgtcgatacgataaacaaagcgatattgacgcgcacgttttcgtttaagtttccctatttggacaacccatttgactctcctgtagagcagcttcgtcttcatcaaattgacgctggctctacttacaacctaaatgccattacagcagaagataagattctcgcgcctcgttttacagatgcaattccgttgagcatgttattgagcaaaatacgcttaaagcttagagtggctttcgtgatttag

SEQ ID NO: 1927 - DNA, 1212 bp, Vibrio sp. 16
gtgaataccgaccttcaactataccctgacgagtcgctagagagcttcttgttacgcttatcgcaagaacaaggctacgagcgattttctcattttgctgaagacatctggtttgacacgatggatcagcatgaagcgatttctggtgctttccctttagagctcaatcgagtcaacatctaccacgctcaaacaacaagccaaatgcgagcgcgggttcttattcaccttgagaaccaattcaagctcaataactttggtgtactgcgtctcgcgctatcacattcgaaagctcaattctctccgcaatacaaagcggtacatagattcgggtctgactacccgtatgcttttcttcgcaaacgcttcacgccaatttgccctctgtgtattagcgaagctccctacattcgccagcagtggcaatatatctctcaccaagcttgtgaacatcatggctgtaaactggttcatcactgccctgagtgtatatcgagactagaatatcaaggtaccgagagcattagccagtgtgaatgtggttatgaactccgaaactcgccagtagaggacgcgtcagaggctgaggtattggtagctcgatggttatcaggaagcgattcaaaacccttgggattattgaaagcaggaatgactttatctgaacgctacggttttttaatttggtatgtaagtcgctatagtgacgtcgatgatattagctttgaagcctttattgactattgcttcgcatggccaacatcactcaaagaggacttagatgcattggtgctaaaagctgatgtagttcgagtgagagattggcgaaaggctttcttttcagaggcgtttggcagcttgcttaaagactgtcgtcatttgccgagccgcgagttgagtaaaaacttagtgttgaatgaagtgttgaggtatctctcagggcttgtttcggataacccagcctcatctaagggaaatgttggtgatgtgctgctaagcccgttagaagcctctacattgctttcttgcacaacagatgaagtatatcggctctatgagtttggtgaaatcaaagctgctattcggccgcgtatgcatactaaaatagccagccatgaatcggctttcacgctaagaagcgtggtagaaactaagctaactcgaatgagctcagaaatggatgggctatgcgtatatttgccggagtggtaa

SEQ ID NO: 1928 - DNA, 2088 bp, Vibrio sp. 16
atgacgaaacttattgagttgctctcaattgaagatgcgaataaaaagcaggcaatgttgaaaaaatggttcatgccttacaccgcagacattgaagtcgacgggcttgaggagacggcattaacggtactagttaacctaagctctcatcataaaggcgataaatgcaatgactggttagacaaagtccgtgcgaagcagcatttgagcgattcagaaaacatagactcatcaataggggaattgaaatggtttcactcgcacaatttgaaatatccagactgccgcgtagcagagcagaggctgattgctaaacctttgcaaaccgatgaagtgtttatttcgggaagaagtcttgaaccgagtttaggctgggcgcacaactcagcatattaccgacacgtattgtggttattgaatccttttcgttggcaatccaaatcaaccaatgttctcacgctagtgcgagaaggacaccacatttggttagcgttattgcaagactttgggttagaggtcaaaactctcgtcgctttgcaaaaggcgattaacgcacaagttccagattcaacctttccaacatcagtcagttcgtatagcaagcagttacgatttccatgggagaacgactatgtatccattaccccggttgtgaaccactcaatacagcgagagctcgaggttcgagctcgggataaggagagcaaactgagttttgttacctcatcactgcccaattccgcaagtattggaagcctttgcggaagccttggtgggaacatgaaaataatgaactatccacttggggtaaagtcgacactaaatgggacgttagcgacaaaccgcaataaaaccggtcgctactttgatgattatcaagttacaaatcatcaagtctgcttggtgctcagcaggttgactggcagtgaaccactcaaaactaacaagcaaagagataaagcacgcaatgtccaaagtaagatcttgagaaagcagatagcgctatggatgttgccattaattgaattgcgcgatcgagctaatttaaatccaagtgagcagtttttaaatagcctagattctttagcgagtgcatttttgacgttacccgagtcagagcttaaatcactcgcaacccaattcaatcaccgacttcactatgtgctgcaggaaaataaatttactcataagtttgcttatcaccccaaactattacaagtcattaagtgtcagatagtttgggtactgaatcaattgagtaagccgagcactagtgatgaaactactcaaagcgaacaatacatctatctgacttccatgcgagttcaggatgcggtggcgatgagtagtccatacttgagtggagcaccgtcacttaccgccctttggggctttatgcaccgttatcagagagagtttagtcagttaatcggtagcgactcatcattggaattctcaagcttttcttttttcgttcgaagtgaggatatacagtccacagccaaactgactgagccaaattcagtagcaactaaaagaacagtttctaatgctaaacgtcctacgattcgttctgagaggttagccgatttagaaatagatatggtgattcgagtcaagggtcacgagcgtttagcagaccacttcagcgagttaaaagcgtcgttaccaatggcttttgcgggaggatacttattccagcctccgatttcatctgaggttaactggctaaacatttttggcagccagtcagaagtgttccacgcgattaaaggagcaccaacatacgggcgttggttatacccaagcgagttgcagcccagtagctttgacgagcttgaattgcagatttcaagcgatgccgacattcatccagtttctctcggctatcatttgctggaaaaaccgacatttcgtgagaactcgataacagagtgtcatgcttatgcagagaacgcgataggggttgcaaaacgcgttaatccgattgaagttcgatttagtggtcgaggtcactattttgagcatgcgttttggtcgctagaatacagctacgcaactattcttatgaaaaactataggaattag

SEQ ID NO: 1929 - DNA, 1038 bp, Vibrio sp. 16
atggatttgtgtagccagctgaattatgttcgttcactttccccaggtaaggcgtatttttactacttatcaaaagatggtgagatgtgtcctgttggtattgatagaacaaggttgcgagcaccaaaagcaggctattccgaagcttacaaaggcaacaatttttttgcaaaaaatgttgctccccaagacttggcttacgctaatcctcaatacattgaagagtgttatgttactccaggggttgatgatatttattgtgcattttctcttcgtatccgtgctaattctttgttccctgaagtatgtaataacgatgatgtacgcaatgcgttagtgtccttgagttcggtatataaggagcttaatggttaccaagagctggcgcaccgttatgccaaaaatattctatcaggagcatggttgtggagaaataaagagtgtcgagcattatcaattgaagtcacgactagcgaagaagagagaataattgttaatgatgcactgagactatcttggtatggacactgggatgaagagtcaacactaagccttgagcttttgatggcttatctaagccgagcgctatcagaccgttctgaatctttctacatggatattcgagcgaagttatctgttggttggggagatgaggtttacccgagccaagagtttttagataccaaagaggatggtattccaaccaagcaattggcaaccgtgaaactgagtaatggcaaagaaacggtggcgtttcatggtcagaaagtgggtgctgcgctgcaatctatagatgactggtggcatgaagacccagataaagttttaagagtgaacgaatatggtgctgatcgagagtatgtgatcgcaagaaggcatgtggcattagaaaatgacttttatcacctaatcaaaaataccgagagttgggtgaaggaaatgaacaaaacaaaagtgattccaaatgatgttcatttcattatgtctgtcttggttaaaggcggtctctttaatggggcaagcggtaaggccaagtga

SEQ ID NO: 1930 - DNA, 603 bp, Vibrio sp. 16
atgaacaaacgctatttcttctatatacgctatcttccggagcaggttgactgtggacttcttgctgggcgctgtattagccaaatgcacaagtttatggtcaataataaacaggctatgaatcaaataggagtgagttttccgtgttggtgtgcggattcagttggtaatagcatcgcctttatttctgaagataaagaccttttgatagggctaacatttcaaccttatttttctgtcatgaaggaagaagaactgtttgagttgtctgatgtacatcaagttccagaaggcgcaactgaattaagattcgtccggaatcagacgataggcaaaagctttataggctctaaaaagcgaagaatgaaacgcagcattgctagagcagaactaacggattcacaatcattacccgttgcagatgaagatcgcgaggttgaacatttccatcgaattccaatttctagtggttcatctaggcaggacttcatcttacatgttcaaaaagaacatgttggcgagagcgtccctacaaactttaatagttatgggttcgccaccaaccaagataaacgaggaaccgtacctgatattcacatttaa

SEQ ID NO: 1931 - DNA, 28 bp, Vibrio sp. 16
gtgacctgccgcataggcagctaagaat

SEQ ID NO: 1932 - DNA, 510 bp, Vibrio sp. 16
  misc_feature (251)..(260): n is a, c, g, or t
tgatgcttgcaagataagtcttcataacgcgaaccaactatcaacgtgttaaaatactatttgcagcataagttcgcataatattgcgccaaaactctgcaaattttagcaactacccaaatccaacgttgtaaaattaccacctcctgtgagccctctgaaatggatggtgatcacattggatggggagtatgtatgaaacacacttttggacacaaaagcgttagagttggcgctctatggcatacgcnnnnnnnnnnttgatgtctgcgttgtattcgaggtgaaaacagaaatcaaactctaaaatggacagagtgcgaacaactgcatcattcttcaagctcatgaacttacagatgttgtgcacgtgagatgacttcttggtttgatcgaacatagcacaatcacttttgttgtaaacctacaacaaaaaaatagactatgaaaacttatggtgcaaatatgaagaaagcctgcaatttatgcgaacatatattgcaggattca

SEQ ID NO: 1933 - protein, 207 aa, Vibrio sp. 16
MFDQTKKSSHVHNICKFMSLKNDAVVRTLSILEFDFCFHLEYNADIKTFTSQPFGFHYQFNNRKCRYTPDFLATDHDEHSTFFEVKHSSQILKPDFRERFKEKQRVAFNEFNRRLVLVTEKQIRMGPTLDNFKLLHRYSGLRTVTEFQKLVLAFIQRKQMVKLQEVSLYFGLSEQDTLISTLPWISSGQVKTNLNNIGFGLETYVWC

SEQ ID NO: 1934 - protein, 621 aa, Vibrio sp. 16
MPSDSNNIFGFFDEFEASEGESQQLPIELIQEPIEIFSTIDTQSPKVQQEVIRRIKIIDFVERRLKGGWTEKNLNPILSLIEPELKLTPPSWRTLATWKKSYFEAGKDPCALIPKHTFKGNRQKEMDSQSLIDEAVQNVYLTRERLSVAEAYRYYKSRVIQINRGIVEGKIKPISDRSFYNRIHDLPPYEVAIARFGKRYADREFRSVGQQVAATKPMEFVEIDHTPVPVILIDDELEIPLGRPYLTMLYDRFSKCIVGCSINFREPSFDSVRKALLNSLLDKSWVKQRYPSIDNEWPCHGKIDCLVVDNGAEFWSKSLEDSLRPLVSDIQYSQAAKPWRKSGIEKLFDQMNKGLVNALPGKTFTNPTQLQDYNPKKDAVVRVSVFLELLHKWIVDYYHMAPDSRERDIPYHKWNQSEWTPSYYSGVEKEQLRVELGLLRHRTIGVAGIRLHNLHYQSSELIEYRKYWASNNGKKLFVKTKTDPSDISSIHVYLESEKRYIKVPAVDNTGYTKGLSLFEHERIQKVRRLNTKQLTDDEALADTFLYMKKRIQEETDRFRGAKSNKASLPKTGNTSKLAKFNDVGSEGPSSINVIPVTHKSEVVSDASEYLDDDDFEDIEGY

SEQ ID NO: 1935 - protein, 371 aa, Vibrio sp. 16
MTMILKILKGINLNLTPKQLEQLKSFETSFIEYPAITEIYSIFDQLRFNHSLGGEPESFLLTGEAGSGKTALINNYLSRFQSGSTWEKQPVLSTRVPSRINEQNTLTQFLVDLDCKSGGRGIRRRNEIALGEAVVKQLKRKSVELIIVNEIQELVEFSTAEQRQVIANTFKYISEEARVSFVLVGMPYADVIATEPQWNSRLSWRRKIDYFKLLKAKSHSNRTVSYGFDLEQKKHFARFVAGLSARMGFDEPPVLTKNEVLYPLFVMCRGECRALKHFLKDALLMSFNENVDTINKAILTRTFSFKFPYLDNPFDSPVEQLRLHQIDAGSTYNLNAITAEDKILAPRFTDAIPLSMLLSKIRLKLRVAFVI

SEQ ID NO: 1936 - protein, 403 aa, Vibrio sp. 16
MNTDLQLYPDESLESFLLRLSQEQGYERFSHFAEDIWFDTMDQHEAISGAFPLELNRVNIYHAQTTSQMRARVLIHLENQFKLNNFGVLRLALSHSKAQFSPQYKAVHRFGSDYPYAFLRKRFTPICPLCISEAPYIRQQWQYISHQACEHHGCKLVHHCPECISRLEYQGTESISQCECGYELRNSPVEDASEAEVLVARWLSGSDSKPLGLLKAGMTLSERYGFLIWYVSRYSDVDDISFEAFIDYCFAWPTSLKEDLDALVLKADVVRVRDWRKAFFSEAFGSLLKDCRHLPSRELSKNLVLNEVLRYLSGLVSDNPASSKGNVGDVLLSPLEASTLLSCTTDEVYRLYEFGEIKAAIRPRMHTKIASHESAFTLRSVVETKLTRMSSEMDGLCVYLPEW

SEQ ID NO: 1937 - protein, 695 aa, Vibrio sp. 16
MTKLIELLSIEDANKKQAMLKKWFMPYTADIEVDGLEETALTVLVNLSSHHKGDKCNDWLDKVRAKQHLSDSENIDSSIGELKWFHSHNLKYPDCRVAEQRLIAKPLQTDEVFISGRSLEPSLGWAHNSAYYRHVLWLLNPFRWQSKSTNVLTLVREGHHIWLALLQDFGLEVKTLVALQKAINAQVPDSTFPTSVSSYSKQLRFPWENDYVSITPVVNHSIQRELEVRARDKESKLSFVTSSLPNSASIGSLCGSLGGNMKIMNYPLGVKSTLNGTLATNRNKTGRYFDDYQVTNHQVCLVLSRLTGSEPLKTNKQRDKARNVQSKILRKQIALWMLPLIELRDRANLNPSEQFLNSLDSLASAFLTLPESELKSLATQFNHRLHYVLQENKFTHKFAYHPKLLQVIKCQIVWVLNQLSKPSTSDETTQSEQYIYLTSMRVQDAVAMSSPYLSGAPSLTALWGFMHRYQREFSQLIGSDSSLEFSSFSFFVRSEDIQSTAKLTEPNSVATKRTVSNAKRPTIRSERLADLEIDMVIRVKGHERLADHFSELKASLPMAFAGGYLFQPPISSEVNWLNIFGSQSEVFHAIKGAPTYGRWLYPSELQPSSFDELELQISSDADIHPVSLGYHLLEKPTFRENSITECHAYAENAIGVAKRVNPIEVRFSGRGHYFEHAFWSLEYSYATILMKNYRN

SEQ ID NO: 1938 - protein, 345 aa, Vibrio sp. 16
MDLCSQLNYVRSLSPGKAYFYYLSKDGEMCPVGIDRTRLRAPKAGYSEAYKGNNFFAKNVAPQDLAYANPQYIEECYVTPGVDDIYCAFSLRIRANSLFPEVCNNDDVRNALVSLSSVYKELNGYQELAHRYAKNILSGAWLWRNKECRALSIEVTTSEEERIIVNDALRLSWYGHWDEESTLSLELLMAYLSRALSDRSESFYMDIRAKLSVGWGDEVYPSQEFLDTKEDGIPTKQLATVKLSNGKETVAFHGQKVGAALQSIDDWWHEDPDKVLRVNEYGADREYVIARRHVALENDFYHLIKNTESWVKEMNKTKVIPNDVHFIMSVLVKGGLFNGASGKAK

SEQ ID NO: 1939 - protein, 200 aa, Vibrio sp. 16
MNKRYFFYIRYLPEQVDCGLLAGRCISQMHKFMVNNKQAMNQIGVSFPCWCADSVGNSIAFISEDKDLLIGLTFQPYFSVMKEEELFELSDVHQVPEGATELRFVRNQTIGKSFIGSKKRRMKRSIARAELTDSQSLPVADEDREVEHFHRIPISSGSSRQDFILHVQKEHVGESVPTNFNSYGFATNQDKRGTVPDIHI

SEQ ID NO: 1940 - DNA, 621 bp, Vibrio sp. F12
atgaaaaaacggattcttagaaactcgtcagtaaaaaacatctcacgctttgtcagtctcaaaacgaactctatccatacagtcgaatccgacttggagtttgacgcatgtttccacttcgaattttcgccacagattataactttcgaagcgcagcctatcggttttgaatattttatcgaaggtaaggtgcataggtatacgcccgactttttagtcacatacaaagattcataccaatcattttatgagataaagcccaagcacattgcagaaaaagatgagtttaaagaaaagtttagagctcagaaagaacaagcattgggcgacggtaaagacctgcacgtattgacagatgatgatattcaaatatacccattgctcgataacttaaggatcattcatcgttatgcttgcgatgagcgtcttaactctattcaaagaaatatattgaatctatttaagaaatatggagagctcaggatagagcaggttgttcaatattcttcagttcattcttctcagttattaccctcactttatgatttgattgctaggcagttgttaagtattgatatgcaccagcctattggttggcaaagccctatttggagctcttag

SEQ ID NO: 1941 - DNA, 1872 bp, Vibrio sp. F12
atgccaagtgaaggttctaagcgatttggcgagctatttcctagtaccaacttcgataatgaatcgaaaccaaaggaaacgctatcactccccttatggaaagatgttgatctgacgtttaaggatgtcttttctgttgatgaagaccgaagaaatgaggccatacatagatataacattctagaattccttatagatcaatatggtaccgatttttcaaaaaagcaaatagatgagtcacttactgctttaatagataaatttggttcaagtacaccatcagcaatcagcatttataggtactggagagattttaaaaaatcaaattttcagcttaactccctaattcctaaagtctctgctggcaatacaaaaagaaatactcccgatgaacttgaacctttaattcaaggtgcaataagaaattacttttctgaagaatgcccgacagcaacatcggcatacgtaactcttgaggttgaaattgatcggcataacgaaatcaatggaactcaatttgaaccgttctcaatacaggcatttaggaagagactaaggaagcactctgagtacgaaaaaatattacttagaaagggaaaaagtgtagctgattctactttcagaaaagtgggggaaaggccagcaacaacacgagtattggaacgtgtagaagcggaccatactaggcttgatttatttattattgatgaaaaaaacggtataccgttagggcgaccctggctcacagttttgtacgatactcatacaaagagcattgtgggtttctatctagggttcgagccgccgagttacttatcagtatcactggcacttgtgaatgcaattcttccaaaagaacacgtcaaagaactatacccatcagtagaagggtgttggccttgttatggcttacctgagcatttgattgtcgataatggtactgagtttaacagtagtgacttcaaaatagcgtgcaaagacctgaaaataaaagttaagaaaaacccgactaaaaagccttggcttaaagggtcagtagagcgatattttcgaactatcaataatcgatttctctctagaatgccgggtaagagttttactaatatatttgagagaaaagattacgatccactcaaaaatgcagttattgataattcgcttctgcaagaaatggttcatatctggatagtggatgtttaccaaaatggaaaaaacgggctagaaaacaatatcccaaatctaagttgggtcgatgctgttaattcttcaattcccccacgtcctttcaaagggtctagagatgaattgaagtttaacctaggaaaaaaccgtgaggtatctctcgataagaatggggttaggttaggcacaacaatacgctactccagtgttcgtctagcaagatattttggacacaaaacttgtaaagacatgaaaagtgtacgtgtgaggatcaagtatgatcctagttgtcttggtagggtttatgtacttgatgaaacgaaagaagagttttttgctgtagacgcaattgatgctgattacgcctattctgtttctgagtggttacacaagacttgttgtaactatgcaaggcgacatattcgcaagaactacaaccacagagatgttgttaaagcttggcgtaaaattctcgatattattgatgaagcatttgaaaaaacaggtcaaaataagaaacaaaactctctagggactacaactacatctcgggtgcagcgtataaaagagcattctaaaagagcaacttccgaagcaaaaacacaacaagttgattatgtaaaatcagaacttgatgatgaattagattgggatatcgaggttaatactaatggttggtcgataaagtga

SEQ ID NO: 1942 - DNA, 981 bp, Vibrio sp. F12
atggatagtaataaaacagaaagcacagctgagatggtcaaacaaatcttcattcagagcccgctaataaccgacattcttgatgatatttcagattgccgagaatttagtgacggtattcatgaaccagactgtatgatcgttgttggagatactgggtcgggaaaaacaacgctgataaataagtatttaaacgaaaaccctcgttcagagacaagcgaaggttcttttataccgattttatcgacttctctcccacccaatgcgaccccgattacggcttctgagcagttgctatctgacctaggggatccactcgctttttctagagggagtgatcctgtcaaggtcgcccaagaaatgagtgacttaatgaagtcatgcggagttgaattaattatcatagatgagtttcaacacatgatagatcggaagaataagcaaattttacatagtgcagctgactggttgaagatgctcattgtacgttcaaaggtaccagtggtgctttttggcatgccttactcagtggtaattttggaggcaaatagtcaattagcaggacgcttcgagttacagcacactcttgagcctttccggttgaatagcaaaaataaccgtagtatctataaaacgtttttaacaatgcttgatgacgcattaccttttggtgagtgttctggtcttgctgaacctgacatgatgaagcgtatctacgcattttcccaaggtaatctacgtcggatcagaaaactcattaatagagcgagtaggcttgcattacgtgatcattcaaataaagttgcattaaaacactttgccaaagcagcacccaaagtcagccaggtcgcatgtgaaaatctaaatccttttgaagttactattaaggaattgaagatcaatcatccccctcaagatattgggtgggaaaattatctgtttcaacaagaaaaagacgtatcggcaaaaggtttattttga

SEQ ID NO: 1943 - DNA, 1185 bp, Vibrio sp. F12
atgcttttacaaagacccaaaccacacagtaacgaaagcttggagagcttctttatccgagttgcaaataaaaatggctatgaagatgtgaaccgttttcttatggccacgaaacgttaccttcaagatatcgacttctcagggttccagaccttccctactaacatctgcaagatgaatcctgcgtcagccaaaagcagttccagtgcccgtacagcctcactcctgaaactcgctcaattaacgtttaacgaacctaccgagttacttggattagcagttaacagaacaaacttaaaatattctccatcaactagtgccgtgatccgtggctcagaagtttttcctcgcagtttactccggacaaagtccataccctgctgcccattatgcttacaagaaaatggttacgcttcttacctttggcattttgagggttacgatcactgccatatccataatgtacctttactcaacagctgtcgctgtggtgctgagtacgactatcgagtgtctggtttaagtggaatgtgcggcagttgtgaagcacctatcgccataaagagtcgagaaaaaagtcataacgccacactctctgttgcgaattggctagcgggcaatgaatcaaaagatctgccagatctccctccaagctaccgttggggcttagtacattggtggattcatatcagcaatgatccgttcgagcacctttcgttcgtccaatttttctcgaactggccaagttcgtttcactccataattgatagtgagatcgagttcaatctagagcacgccattgttggaaaaagtgaattacggataaaagatctcctagggcggatattgtttagttctgttcggttaccagaacgcaacctgcagcacaatatcgttctaggagagcttctacggcatacagagatgcatttatgggataacaacggtctgatcgctaaccttcgaatgaacgctctagagactactgtattcctcaattgcagtaaggatgagttagcctcaatggtagaacagcgcatcttaaagccaaatcgtaaaactaagccaaacatacctctggtggttaacgactacttattttatttcggcgacatcttctgcctttggttagccgaatttcaaactgatgaatttaaccgctctttctatgtgtcgaggtggtaa

SEQ ID NO: 1944 - DNA, 1923 bp, Vibrio sp. F12
atggagagtctgaaagagttactacaatcaagaccagatgatttgaacgtagagttaaagcgaacattccgccctcttactccacatatcaatatcgatggaaaggagcttgatgctctcactgtattagtgaacttaaccgacaaaacagccgttcaaaaagatctacttgatagggttaaatgcaagcaaaagcttagagacgaaaaatggtgggctcgctgtctaaaaacggttgaatacaggcaaagccacaacctaaaatttccagacatacgctctgaaggtgttattcgcgcgactcctctggggcagctacccgattttttactttcatcttctaaattagaaccacacaactgggcgtacagccatgattccagcgatgttaacaaaagcgctttattaaccaatgaatttcgttggaatggtgtaatttcatgccttggtgatttgcttaaagatgtagaacacccgttgtggcaaaaactcaatacgcttggctgctaccagaaaacacgtaaggctatcgctaaacaattggctcagatttctcaaacaacgattaacgtcagtctcgctccaaattacttaactcaactatctttgcctgataacgacagttcttatatttcactctcgccagtggcttctcaatcgatgcaaagtcactgttatcaagcgctaaaaaatgagtatcgctatacagcgttaacccgttacagtcgcagtactaacatgggagtattacctatgacatgtggtggtgctttgaagatgttgaaaactgtccctaacttttcccttacacatcattatcagataaacattggaaaatcttggttgacctcaagtcatattcaatcgttaaaacagtaccaaacgcatactcaatatttaatgccaaaaaacaagcgagtggcttaccgcagaacagtcaaaaacgagatacaagagatggttaaggcttggttggcaacacaagacaacaccatggatgttaatactcttgttcaacatttaaacgatgatctatcccgcttcaaatcagctaagtgtttcgcatacgagccgagcattactaaactcctgcttgggctcatcaagcgtgaactaaccgaacctacaaccgtttcaactaatatttgccgcagtgaaaaaaaggattcattctttgtgattccaaatataagagtttgtggagcaagcgcgttgagttcacctatcacggtcggtcttccatcactcactgctttcttggggtttactcacgcgtttgaacgtaacttaaatgagtcttttcctacgctcgcaattgattcgtttgccatctgtgtccatcaactacacgttgaaaaacgcggtttaacaaaagaatatatacaaaaagcaaaccacaccatatcgccacccgctacatacgatgactggcagtctgatttggtctttagtttggtgattaggtttaatcgtagcttgaacgttgatgacaatactattgttcgagctctgccgaaacggtttgccagaggttccgctaaaatagctattgcagatttcaaatacatccggtcattttcaacgttagaaaagacgattcaatcctttcctcagaaaaccggcaaatggctatcgatgcatactgaacctatcgaaaacatgagtgatattttatcggaagttaaagagaaccgaaaattaaccccaagctgtgttgggtatcattttcttgaagagccgaccgacaaacctaactctcttcgaggttataaacatgctttttctgagtgcatcattggtctgattgagccaatcacttttgatcaaaacaccgacataaatactattttgtggcatcacaagtgctatcaaaactacctttctgtgcagccaaggagtacctatcatggaactaccgactaa

SEQ ID NO: 1945 - DNA, 1062 bp, Vibrio sp. F12
atggaactaccgactaacctagcctatgaacgctctattgatccttctgatgtgtgctttctagttgtgtggccagatgggcgaaagacccccttaacctacacttctcgtactgtactaggacaaatggaaaccgcagccttagcttatgagccgtcggggcggaccaaagagagtgcaaccgctgaaaaactggctcaaggtaacccacatcaagtcgatttttgtcatgctcctttcggtgcgagccacattgaatgctacttttcggtctctttttcttctgagctacgcaaaccttacaagtgtaattcgtctacggttaaacacacactaatgcagctaatcaaagcgtatgaagaaaatattggttggaatgaattggtttctcgatatctagtcaatatatgtaatggatcatggctgtggaaaaatactaaaaaagcctattgctgggatatagagttaaccccttggccctgggcgggaggtgctgtcaaatttcaaaacataagggctaactaccttgaaagaagtgactttgagaaccataaagattgggaagctattgctcaaatgaccaaaaatgctttttctcactctaatggtttggccatatttgaagtaaaagccaccttgcggctaccaaccaataaacagattttcccgagccaagcattcaccgaaaatgaaagtaacaacactaataaatctaagaaacaaagcaagggacgaatttttcaaagcacaacggttgacggtgaacggagcccaatattgggtatttataaaactggtgccgccattgcgaccatagacgactggtaccccgatgcaactgaggcactacgtgtcggccggtttggggttcataaagaagatgtcacttgctaccgtcacccttctacacaaaaagatttcttttttatacttcagcacacagagtcttatattgaagcactcacgtcttcagataaaccaaatcaagagaccataaacgacctgcattttttggtcgcaaatatcatcaagggtggaatgttccagcataagggaaattaa

SEQ ID NO: 1946 - DNA, 600 bp, Vibrio sp. F12
atgaagtggtactacaaaacggtcacttttctgccagcgcgttgtaacaatgaatcattagccgctaagtgccttcggattcttcatggctttaactatgagtatgaaacaagaaatattggcgtttcatttcctctttggagtgactataccatcggaaataaaatttcttttgtgagcacaaataaaatcgaactcgatttgctactcaaacagcactacttcacccaaatgaaagagctgcactattttgatatatcaaatacaaaggttgtccctgacggctgcgagtatgtttcatttaagcgttgccagtcaatagacaaagcaacacctgcaggacaagctagaaaagcgaaaagattaaaaaaacgtgcggaagaaagaggtgaagtgtttgacttatcctcgttcaaacaacacgaagttgttgcactccatcactaccactcacttgaggaagacagtaaaagtcgtggaggtagttttcgactcaatataagaacattcaaagaagctcgcttagacggagatgcactatttagcagctatggtcttgcgaatactggaaacaaatctcaacccgtccccctaatttga

SEQ ID NO: 1947 - DNA, 28 bp, Vibrio sp. F12
gtgaactgccgaataggtagctgataat

SEQ ID NO: 1948 - DNA, 510 bp, Vibrio sp. F12
  misc_feature (251)..(260): n is a, c, g, or t
tgttgaaacaaccataaagtgataacaacgaatcaattaaaatcataggcttaatcgaaaaacaaccatatcttgatatcgcataaaacaaccataagttgatattttggtgaaaaggatattccaaccttcatagtttagtaagaaactttcttacagaacttacacttatgcctgatttgtactgcatagcatgttttcaccggcattgggggcgaactcgaaagctaaaaaactatagaattcatcannnnnnnnnnaaaattcgaagtggaaacatgcgtcaaactccaagtcggattcgactgtatggatagagttcgttttgagactgacaaagcgtgagatgttttttactgacgagtttctaagaatccgttttttcataataaacaaccatacctgtagtaaactttctcaagtgttgtacactttataagcaatttcaaggtatggttgtttttatttcagcgtatggtttcgtaaaatcaacgtatggttttttttaca

SEQ ID NO: 1949 - protein, 206 aa, Vibrio sp. F12
MKKRILRNSSVKNISRFVSLKTNSIHTVESDLEFDACFHFEFSPQIITFEAQPIGFEYFIEGKVHRYTPDFLVTYKDSYQSFYEIKPKHIAEKDEFKEKFRAQKEQALGDGKDLHVLTDDDIQIYPLLDNLRIIHRYACDERLNSIQRNILNLFKKYGELRIEQVVQYSSVHSSQLLPSLYDLIARQLLSIDMHQPIGWQSPIWSS

SEQ ID NO: 1950 - protein, 623 aa, Vibrio sp. F12
MPSEGSKRFGELFPSTNFDNESKPKETLSLPLWKDVDLTFKDVFSVDEDRRNEAIHRYNILEFLIDQYGTDFSKKQIDESLTALIDKFGSSTPSAISIYRYWRDFKKSNFQLNSLIPKVSAGNTKRNTPDELEPLIQGAIRNYFSEECPTATSAYVTLEVEIDRHNEINGTQFEPFSIQAFRKRLRKHSEYEKILLRKGKSVADSTFRKVGERPATTRVLERVEADHTRLDLFIIDEKNGIPLGRPWLTVLYDTHTKSIVGFYLGFEPPSYLSVSLALVNAILPKEHVKELYPSVEGCWPCYGLPEHLIVDNGTEFNSSDFKIACKDLKIKVKKNPTKKPWLKGSVERYFRTINNRFLSRMPGKSFTNIFERKDYDPLKNAVIDNSLLQEMVHIWIVDVYQNGKNGLENNIPNLSWVDAVNSSIPPRPFKGSRDELKFNLGKNREVSLDKNGVRLGTTIRYSSVRLARYFGHKTCKDMKSVRVRIKYDPSCLGRVYVLDETKEEFFAVDAIDADYAYSVSEWLHKTCCNYARRHIRKNYNHRDVVKAWRKILDIIDEAFEKTGQNKKQNSLGTTTTSRVQRIKEHSKRATSEAKTQQVDYVKSELDDELDWDIEVNTNGWSIK

SEQ ID NO: 1951 - protein, 326 aa, Vibrio sp. F12
MDSNKTESTAEMVKQIFIQSPLITDILDDISDCREFSDGIHEPDCMIVVGDTGSGKTTLINKYLNENPRSETSEGSFIPILSTSLPPNATPITASEQLLSDLGDPLAFSRGSDPVKVAQEMSDLMKSCGVELIIIDEFQHMIDRKNKQILHSAADWLKMLIVRSKVPVVLFGMPYSVVILEANSQLAGRFELQHTLEPFRLNSKNNRSIYKTFLTMLDDALPFGECSGLAEPDMMKRIYAFSQGNLRRIRKLINRASRLALRDHSNKVALKHFAKAAPKVSQVACENLNPFEVTIKELKINHPPQDIGWENYLFQQEKDVSAKGLF

SEQ ID NO: 1952 - protein, 394 aa, Vibrio sp. F12
MLLQRPKPHSNESLESFFIRVANKNGYEDVNRFLMATKRYLQDIDFSGFQTFPTNICKMNPASAKSSSSARTASLLKLAQLTFNEPTELLGLAVNRTNLKYSPSTSAVIRGSEVFPRSLLRTKSIPCCPLCLQENGYASYLWHFEGYDHCHIHNVPLLNSCRCGAEYDYRVSGLSGMCGSCEAPIAIKSREKSHNATLSVANWLAGNESKDLPDLPPSYRWGLVHWWIHISNDPFEHLSFVQFFSNWPSSFHSIIDSEIEFNLEHAIVGKSELRIKDLLGRILFSSVRLPERNLQHNIVLGELLRHTEMHLWDNNGLIANLRMNALETTVFLNCSKDELASMVEQRILKPNRKTKPNIPLVVNDYLFYFGDIFCLWLAEFQTDEFNRSFYVSRW

SEQ ID NO: 1953 - protein, 640 aa, Vibrio sp. F12
MESLKELLQSRPDDLNVELKRTFRPLTPHINIDGKELDALTVLVNLTDKTAVQKDLLDRVKCKQKLRDEKWWARCLKTVEYRQSHNLKFPDIRSEGVIRATPLGQLPDFLLSSSKLEPHNWAYSHDSSDVNKSALLTNEFRWNGVISCLGDLLKDVEHPLWQKLNTLGCYQKTRKAIAKQLAQISQTTINVSLAPNYLTQLSLPDNDSSYISLSPVASQSMQSHCYQALKNEYRYTALTRYSRSTNMGVLPMTCGGALKMLKTVPNFSLTHHYQINIGKSWLTSSHIQSLKQYQTHTQYLMPKNKRVAYRRTVKNEIQEMVKAWLATQDNTMDVNTLVQHLNDDLSRFKSAKCFAYEPSITKLLLGLIKRELTEPTTVSTNICRSEKKDSFFVIPNIRVCGASALSSPITVGLPSLTAFLGFTHAFERNLNESFPTLAIDSFAICVHQLHVEKRGLTKEYIQKANHTISPPATYDDWQSDLVFSLVIRFNRSLNVDDNTIVRALPKRFARGSAKIAIADFKYIRSFSTLEKTIQSFPQKTGKWLSMHTEPIENMSDILSEVKENRKLTPSCVGYHFLEEPTDKPNSLRGYKHAFSECIIGLIEPITFDQNTDINTILWHHKCYQNYLSVQPRSTYHGTTD

SEQ ID NO: 1954 - protein, 353 aa, Vibrio sp. F12
MELPTNLAYERSIDPSDVCFLVVWPDGRKTPLTYTSRTVLGQMETAALAYEPSGRTKESATAEKLAQGNPHQVDFCHAPFGASHIECYFSVSFSSELRKPYKCNSSTVKHTLMQLIKAYEENIGWNELVSRYLVNICNGSWLWKNTKKAYCWDIELTPWPWAGGAVKFQNIRANYLERSDFENHKDWEAIAQMTKNAFSHSNGLAIFEVKATLRLPTNKQIFPSQAFTENESNNTNKSKKQSKGRIFQSTTVDGERSPILGIYKTGAAIATIDDWYPDATEALRVGRFGVHKEDVTCYRHPSTQKDFFFILQHTESYIEALTSSDKPNQETINDLHFLVANIIKGGMFQHKGN

SEQ ID NO: 1955 - protein, 199 aa, Vibrio sp. F12
MKWYYKTVTFLPARCNNESLAAKCLRILHGFNYEYETRNIGVSFPLWSDYTIGNKISFVSTNKIELDLLLKQHYFTQMKELHYFDISNTKVVPDGCEYVSFKRCQSIDKATPAGQARKAKRLKKRAEERGEVFDLSSFKQHEVVALHHYHSLEEDSKSRGGSFRLNIRTFKEARLDGDALFSSYGLANTGNKSQPVPLI

SEQ ID NO: 1956 - DNA, 624 bp, Vibrio splendidus strain UCD-SED10
atgtacgaccaaaccaaaaaatcatcagctgttcacaacatttgtaaattcatgagtttgaaaaatgactcagttgttcgaacaatgtccatgcttgagtatgatttttgttttcatgctgaatacaatcctcaaatagttagatatgaatctcagccacatgggtttgagtactacttcaatgggcgctattgccgctacacaccagactttcagcttttcgatagcatagatacgccttctctgattgaagtaaagcattcaagtcagatccttaaaccagattttcgagcaaggtttaaagaaaagcagcttgtcgctcaagctgagtatggaaaaaaactcatcttagtgaccgagaagcagattcgaactggttttctacttagtaaccttaaattactccacggctattcagggattcgtacaatcactgatattcaaaaacatgtgcttcagtttgttcaagctaatagaagcgtgacccttcattatctttcacaccaacttaaaatctctccagatgaaacattaacagcagctttgtgctggctatcttcaggtgaaatacaaacagattttaatcagaaaaaatttgatttagaaagttctgtttggtgctag

SEQ ID NO: 1957 - DNA, 1866 bp, Vibrio splendidus strain UCD-SED10
atgagtaatgatgctctctttggttttcgtgatgaatctagtagtttcgacaatgatgtagcagatgataaaacgcttccaacagaatttttagcagaagacgaaaatcttgaattggcatttggtgatctaccacacaaagagactgcattgtatcggttggacttaattcgttatttggaaaggcacgtacaaggaggttggacgcccaaaaacctagataagctcttggaagagtatgctttattgaagaaaacttcggtcccgtcatccagaacggttgctgattggaaaaagctctattacgagtcaggtaaagatgtagcgtctcttgttcctgggcatagcaaaaaaggaaacagaatactaaagaatgattcatctgatttagtaacagaagcgattcaaaccaagtttctgaccaaagagcgagtatcagtcaacaccgcctatgagtactacaaatatcgagttattgaagagaaccgacaattaacgcaaattaaaatagcgacaatttcacaacggacattttacaatcgtgtaaatgcactacctccctatgaagttgctttggctcgttatggtaaacgatatgctgataataagtttaagactgttgggtcaatcattccggcaacgcgtccaatggaatgtgtagaaatagatcacactacagctcctgttattttgcttgatgatgatttggatcttcctcttggcagaccacacttaacaatcctttatgatagatactctacttgcattgttggtctttctgtcaattatagagatcctagttacgagacagtacgagcagctttcctcaattcagttctcaagaaggattgggttaaagaaaagtacccaagcattaaatctgaatggccttgctacggaaatattacaaatttgatagtggataacggtgcggagttttggagtgatagcctagagtcagcattaaagccattagtaacagatattcaatataatcaacgtggtaaaccgtggcgaaaagcgggtgttgaaaagtcttttgataccttctataagaaactatttagtcgtttcccaggaaaaaccttcacgaaccctactcagttaaaagactacaacccgaagcgagacgctgtcattaatgtgtctgattttctcgagctgttacataagtggcttattgacgtttatcataaaaaagctgacacgaggtacaagagagttccctaccagaaatggacagagtcgcaaggaaagataatcttttgtgaaggccctgaagcagagcaattaaagattgagcttggagttgtaaaccatcggactataagaagaggcgctattgaattgcattctcttaaataccaatctgatgagttggaagagtacggtaagcagtattctagtcgtgcaagaaaaagcgcttatgtgaaaaccaagacagacccaaacgatatcagctcgatttacgtttatcttgaggaagagaaaaaatacatcaaagtcccagcagtcgatcatacgggttatacaaaaggccgatctttatatgaacatcaacggattaacagtttaagaaggttgaaagttcgtttgggagagcaagacgaatcactagccgatgcgtcattgtatttggacagagctatggatgaagcaatagaacgtatgagtcgttctaagtccaaaaaatcggcgcttcctaaaacaactcatgcttcaaaaatagcaaagcaaagaggtgttggtagcgaagggcctagcaccattgtcattacgtcacctaaacctatcagtgaagtaccaaaagaagtaatagatattggtactgctagtgatgacctcagcgatatagaggggtattag

SEQ ID NO: 1958 - DNA, 1068 bp, Vibrio splendidus strain UCD-SED10
gtgaacatacttagtgagcttcaaatagagcaatatacatcttttagagagtgtttcttagaataccctcagctgacggaaatttataacgtctttgatcgaatggtattgaacagctgtcttggaggggaacaagagtcactattgctaacgggagatacaggtgttggcaagacggcgatgatagataattatgttgcaaggttcgctgctaagggtagccgctgggctgaaatgccagtattaaaaactcgcatcccaagtaaagttcgtgagcaaaatacgttagaaagattattaattgatttagatagtcgagcctctagccgccgcaggagaccttacaaagaaggagcgttagaacaaggagtcatcaaaagtttagttgaaaaaaaagtgaagcttgtgatcgttaatgaggttcaggagctgatggaattcaaagatgctaatgaacgacaaacaatagcgaatacttttaagatgataagtgaggaagctcaagtttcatttgtcttggtgggtatgccctatgcgactatgctcgctgaagaagaccaatggaattctcgtttaggctggaagcgacacttaagttattttcacctttctaagctgagcgaagccgataacaaaggttatatacctgatgcagaagggaaacggcattttgcaagctttgttgccggacttgcaggccggatggggtttgaaaaacgccctaacttaactggggatgaaattctattgcctttattttcagtctgtcgcggagaatgccgtgtgctgaagcactttcttgcggatgcgttactcaacgcattgcaatcttcaaaggatacgattgataagccattattatcggcttgttttgatactaaatacccttatgcgaaacagaatcctttcgagtgtaagttaacagaactcaagctagtagaactgaaaacagaaacttcttacaacaaaggtgctcaatttaaagaagaccgattaataggtcggtcatttactgatttattaccagttcatatgttgctgagtaagacacctttaaaagctcagtga

SEQ ID NO: 1959 - DNA, 1212 bp, Vibrio splendidus strain UCD-SED10
gtgaaaacggacattcaactttaccctgacgaatcgctcgaaagcttcttgttgcgcttatcgcaagagcaaggttacgagcgattttctcatttcgccgaagatatctggttcgacaccatggatcagcatgaggcgattgctggtgctttccccttagagctcgaacgagtcaatatctaccacgctcaaaccacaagccaaatgcgggtgcgagtgcttatccaccttgagaaccaattaaagctcaacaactttggtgtactgcgtctagcgttatcacattcaaaagctcaattctctccgcaatacaaagctgttcatagatttggtgttgactacccttatgcttttcttcgcaaacgcttcacgcctatttgccctctgtgtattggtgaagctccctacattcgccagcagtggcaatttatctctcaccaagcttgtgaacatcatggctgtaaactgatttatcactgccctgagtgtaagtcgagacttgaataccaacgtaccgagagtagtagtcaatgtgaatgtggtttcgaactccgaaactcgccagtcgaagatgctccagaggctgagaccttggttgcccgatggttgtcaggaaatgattcaaaacccttgggattgctgaaggcagaaatgacgttatctgagcgctatggtttcttactttggtatgtaaatcgctatggtgatatcgatggtctctgttttgagtcattcatcgaatactgcggctcttggccaacgtcattgtggcaagacttcgatgttttgaaagagaagacagagctcgtccgagcaaaagattggaagaagatgtttttcaatgaagcttttggtgctctgcttaaagattgccgtcagttacccagtcggcagctgagtcacaatatcgtgcttactcaggtgttagcttactttacacagctgatggcaacagtatcttcaagcgcgaaaggtaatataggtgatgtgctgctcagccccttagaagcttctacattgctttcttgtacaacagatgaggtatatcggttgtatgagtttggtgagatcaaagccgcgatcaggccgcgaatgcacacaaagattgcaagtcacgaatcggcgtttactctgagaagtatcattgaaacaaagttgacgcgaatgagctctgaaagtgatggtttaagcgtgtatctaccagagtggtaa

SEQ ID NO: 1960 - DNA, 2088 bp, Vibrio splendidus strain UCD-SED10
atgacaaaattaagtgacctattggcaatcgaagacgaagtagtaaagcaggcttctctaaagaagatgttcatgccctatacggaagatgtctgtgttgaagggtttgaaaaagaagcgctaacgatcttgctcaatctcagttcaagccatcaagcggatagatgctcggattggttggatgttgcccgtgctaaaaggtattttaaagcggctgagaacctagacacatcccttgatgagatcaaatggttccacactcataatctcaagtttccagactgccgagttaaagatcagcgaataattgcgcagcctcttgtgacaaccgaggcatttatttcaagcgcagcattagagcaacgcttggggtgggcgcataactctgcagtgtatcgccatacattgtggttattgaatccttttcgttggcaatcacagtccgtgagtcttctttcacttattcagcaagaaacccctgtttggctcgagctgcttaaaggttttggtttaggcactaagtcacttgttcgcttacaaaacacaatggcagaacagctacctgaaaatagcctccctgacagagtcagtacttacagcaagcaactacggtttccatggggggatgattatgtttcggtgaccccagtggtcagtcatgccatccaaagagagttagaagtgagatcgagaagtcgagaaagcaagctcagctttgtgtcttcatcgctgccaaactcggcaagtatcgggaatctgtgtggcagtttaggtgggcatatgaaagtccttaactacccgctagacgtcaaaccagcacaaggtgggacgttaactgaaagtcgcaaaaagagtggctgctactttgatgactatcaggtaactaacgccaaaatttgtcaggtgttaaatcacttaattggatcagaaccatcaaaaacacagaagcaaagagagatcgctcgtaaggttagaagtaagatattgcgaaagcagatagccttgtggatgcttccattaattgagctaagagatattgttgatgctgaccctaatcaacagcaattggaacatgatgacactttaactcaagccttttgggcgctaccagaatcggatctaggctctttagctagtgagtttaactgtcgcttacatctcgcgtttcaaaataataagtttgccgcaaagtttgcctatcaccccaagcttatgcaggtcgtcaaagcccaaatcgtatgggtactcgaacaaatcagtaaaccaaatggcaatgaagataaggtaacgggtgagcagtatatctatttgtcatcaatgagagtgcaagatgcggtcgcaatgagtagcccatacctatgtggtgctccttctttgacggctatttggggttttatgcatcgctatcaaagagagtttaataagctagctaattgtgattccctgtttgagttttcgagtttctctttttatgttcgaagtgagaacattcaaccgacggccaagcttaccgaacccaactcagtcgccaaagcgcgaacggtttctaacgcgaagcgaccaactattcgtagtgaacgattggcagacctagaaatagacttagttattagagtccatagtgacagccgaatttcagattttaagtccgcgcttaaaacagctcttcccgtagttttttccggaggggcattataccaaccacagctatcgacgcagattgagtggctaaggacgtttaccagcaggagtgagcttttccatgtcataaaagggttaccagcatacgggcgatggttatatccaagtgaaaaccagccgagtgattttgatgagctagagcgttttattactaaagacgctgataatttgccagtttctattggctaccatttgttagaacaaccaactaaacggggcaactcaatcaccagttgtcacgcttatgcagagaatgcgatagggcttgctcagcgagtaaacccgatagaagtacgttttagtggaagagatcactttttaaaccacgccttttggtcgatagaatgcagtagcgaaactattcttataaaaaactatagggattaa

SEQ ID NO: 1961 - DNA, 1032 bp, Vibrio splendidus strain UCD-SED10
atggaactttgcactcagctgaattacgttcgatcactctctgctggcaaagcatatttctaccatctttctaaaagtggtgagatgtgtccccttgaagttgatagaactaggttgcgcgcaccaaaagggggttatgcagaagcctataaagggggcaagtttgtaaaaaagaatgttgctccacaagacttagcttactccaatcctcagttcattgaagagtgttacgtaaagccgggtgtagatgatatctactgtgcattcccccttcgaattcgagccaattctctaacccctgagatctgtagtgacgatgaagtgcgcagtaaactttcgttactggctaacacttataaagagctcaatgggtatcaggagctcgctcatcgatacgcgaaaaatatcctgcttggcagttggctgtggcgtaacagagagtgtcgaaagctgttgatagaagtgaccaccagtgattcacaaaccctgattgtagaaaacgcaacaaagctttcttggtatggtcattgggatgaggcttcagcagaatgcctagaaaagctcacagcctatttgatgcgagccctgtctaacccgaccgaatatttctatatggatgtcaaagctaaaattggagttggttggggagatgaggtttacccaagccaagagtttttagagagccgagaagatggtgttcctactaagcagttagctactgtcgaactattggacggaaaagaaaccgttgcgtttcatggtcaaaaagttggagccgcgttgcaatcgattgacgattggtggcatgaaaacgcagataaacccttaagagtgaatgagtatggaactgaccgagagtacgttatagcaaggcgacatgtttcctatggaaatgacttttaccagttagtcagaaatacagagaattggattgagacaatgacagcttctcagaccatcccaaatgacgtgcactttattatgtcggtcttgattaaaggtggtctcttcaattgttccaaagcgaagtaa

SEQ ID NO: 1962 - DNA, 606 bp, Vibrio splendidus strain UCD-SED10
atgacgacgcgttactacttctgtatacgttatacccctgttcaagccgactatgagctgttagcaggacgttgtatctctcaaatgcacttgtttatggtcaataaccgacaagccatcaataaaataggcgtgagttttcccgactggagtgatgttacggttggtcaaaccatagcctttgttgctgaagataaagagatgatggtcggactctcttttcaaccctatttttctttgatggtaaatgaaggtttatttgagatttccagtgtatgtgaggtgccggatactgcgatagaggtgaggtttacccgtaaccaaacgattgggaaaagctttctgggttccaagaaacgtcgaatcaaacgtagcatggcgagagccgaactatctggtgttgaaccatcgttaccagccactaatgaagagcgtgtcatcgatagttttcatcgaataccaatctccagcggttcatctggagaagattatatgttgtttgtacaaaaggagtttgtcggtgagcgcggtacagcaaactttaatagctatggtttagccaccaatcaagaaagaaaaggcacggtacctgagttacgtttttaa

SEQ ID NO: 1963 - DNA, 26 bp, Vibrio splendidus strain UCD-SED10
gtgtcctgccgcataggcagctaaga

SEQ ID NO: 1964 - DNA, 510 bp, Vibrio splendidus strain UCD-SED10
  misc_feature (251)..(260): n is a, c, g, or t
tgatgcttgcaacataagtccgcataattcgaaccaagtatcaaagagttaaagtactatttgcaacataagttcgcataacattgcatcgaaagtctgcatatttacagaactactaaaattcaacgtagtaaaattaccacactccgatcaacccttcgaaagacatagtgtacatgtatgggtaagaattcagtctctgaaggttttggacaattttgagttagtgtctttgctaatttagcaagtcnnnnnnnnnnactatttgaggattgtattcagcatgaaaacaaaaatcatactcaagcatggacattgttcgaacaactgagtcatttttcaaactcatgaatttacaaatgttgtgaacagctgatgattttttggtttggtcgtacatagcaaaagcacttttgttgtaaacctacaacaaaaaatagaccatgaagacttagggtgcaaataagaaaagaagcctgcaatttatgcgaacatatattgcaggcttca

SEQ ID NO: 1965 - protein, 207 aa, Vibrio splendidus strain UCD-SED10
MYDQTKKSSAVHNICKFMSLKNDSVVRTMSMLEYDFCFHAEYNPQIVRYESQPHGFEYYFNGRYCRYTPDFQLFDSIDTPSLIEVKHSSQILKPDFRARFKEKQLVAQAEYGKKLILVTEKQIRTGFLLSNLKLLHGYSGIRTITDIQKHVLQFVQANRSVTLHYLSHQLKISPDETLTAALCWLSSGEIQTDFNQKKFDLESSVWC

SEQ ID NO: 1966 - protein, 621 aa, Vibrio splendidus strain UCD-SED10
MSNDALFGFRDESSSFDNDVADDKTLPTEFLAEDENLELAFGDLPHKETALYRLDLIRYLERHVQGGWTPKNLDKLLEEYALLKKTSVPSSRTVADWKKLYYESGKDVASLVPGHSKKGNRILKNDSSDLVTEAIQTKFLTKERVSVNTAYEYYKYRVIEENRQLTQIKIATISQRTFYNRVNALPPYEVALARYGKRYADNKFKTVGSIIPATRPMECVEIDHTTAPVILLDDDLDLPLGRPHLTILYDRYSTCIVGLSVNYRDPSYETVRAAFLNSVLKKDWVKEKYPSIKSEWPCYGNITNLIVDNGAEFWSDSLESALKPLVTDIQYNQRGKPWRKAGVEKSFDTFYKKLFSRFPGKTFTNPTQLKDYNPKRDAVINVSDFLELLHKWLIDVYHKKADTRYKRVPYQKWTESQGKIIFCEGPEAEQLKIELGVVNHRTIRRGAIELHSLKYQSDELEEYGKQYSSRARKSAYVKTKTDPNDISSIYVYLEEEKKYIKVPAVDHTGYTKGRSLYEHQRINSLRRLKVRLGEQDESLADASLYLDRAMDEAIERMSRSKSKKSALPKTTHASKIAKQRGVGSEGPSTIVITSPKPISEVPKEVIDIGTASDDLSDIEGY

SEQ ID NO: 1967 - protein, 355 aa, Vibrio splendidus strain UCD-SED10
MNILSELQIEQYTSFRECFLEYPQLTEIYNVFDRMVLNSCLGGEQESLLLTGDTGVGKTAMIDNYVARFAAKGSRWAEMPVLKTRIPSKVREQNTLERLLIDLDSRASSRRRRPYKEGALEQGVIKSLVEKKVKLVIVNEVQELMEFKDANERQTIANTFKMISEEAQVSFVLVGMPYATMLAEEDQWNSRLGWKRHLSYFHLSKLSEADNKGYIPDAEGKRHFASFVAGLAGRMGFEKRPNLTGDEILLPLFSVCRGECRVLKHFLADALLNALQSSKDTIDKPLLSACFDTKYPYAKQNPFECKLTELKLVELKTETSYNKGAQFKEDRLIGRSFTDLLPVHMLLSKTPLKAQ

SEQ ID NO: 1968 - protein, 403 aa, Vibrio splendidus strain UCD-SED10
MKTDIQLYPDESLESFLLRLSQEQGYERFSHFAEDIWFDTMDQHEAIAGAFPLELERVNIYHAQTTSQMRVRVLIHLENQLKLNNFGVLRLALSHSKAQFSPQYKAVHRFGVDYPYAFLRKRFTPICPLCIGEAPYIRQQWQFISHQACEHHGCKLIYHCPECKSRLEYQRTESSSQCECGFELRNSPVEDAPEAETLVARWLSGNDSKPLGLLKAEMTLSERYGFLLWYVNRYGDIDGLCFESFIEYCGSWPTSLWQDFDVLKEKTELVRAKDWKKMFFNEAFGALLKDCRQLPSRQLSHNIVLTQVLAYFTQLMATVSSSAKGNIGDVLLSPLEASTLLSCTTDEVYRLYEFGEIKAAIRPRMHTKIASHESAFTLRSIIETKLTRMSSESDGLSVYLPEW

SEQ ID NO: 1969 - protein, 695 aa, Vibrio splendidus strain UCD-SED10
MTKLSDLLAIEDEVVKQASLKKMFMPYTEDVCVEGFEKEALTILLNLSSSHQADRCSDWLDVARAKRYFKAAENLDTSLDEIKWFHTHNLKFPDCRVKDQRIIAQPLVTTEAFISSAALEQRLGWAHNSAVYRHTLWLLNPFRWQSQSVSLLSLIQQETPVWLELLKGFGLGTKSLVRLQNTMAEQLPENSLPDRVSTYSKQLRFPWGDDYVSVTPVVSHAIQRELEVRSRSRESKLSFVSSSLPNSASIGNLCGSLGGHMKVLNYPLDVKPAQGGTLTESRKKSGCYFDDYQVTNAKICQVLNHLIGSEPSKTQKQREIARKVRSKILRKQIALWMLPLIELRDIVDADPNQQQLEHDDTLTQAFWALPESDLGSLASEFNCRLHLAFQNNKFAAKFAYHPKLMQVVKAQIVWVLEQISKPNGNEDKVTGEQYIYLSSMRVQDAVAMSSPYLCGAPSLTAIWGFMHRYQREFNKLANCDSLFEFSSFSFYVRSENIQPTAKLTEPNSVAKARTVSNAKRPTIRSERLADLEIDLVIRVHSDSRISDFKSALKTALPVVFSGGALYQPQLSTQIEWLRTFTSRSELFHVIKGLPAYGRWLYPSENQPSDFDELERFITKDADNLPVSIGYHLLEQPTKRGNSITSCHAYAENAIGLAQRVNPIEVRFSGRDHFLNHAFWSIECSSETILIKNYRD

SEQ ID NO: 1970 - protein, 343 aa, Vibrio splendidus strain UCD-SED10
MELCTQLNYVRSLSAGKAYFYHLSKSGEMCPLEVDRTRLRAPKGGYAEAYKGGKFVKKNVAPQDLAYSNPQFIEECYVKPGVDDIYCAFPLRIRANSLTPEICSDDEVRSKLSLLANTYKELNGYQELAHRYAKNILLGSWLWRNRECRKLLIEVTTSDSQTLIVENATKLSWYGHWDEASAECLEKLTAYLMRALSNPTEYFYMDVKAKIGVGWGDEVYPSQEFLESREDGVPTKQLATVELLDGKETVAFHGQKVGAALQSIDDWWHENADKPLRVNEYGTDREYVIARRHVSYGNDFYQLVRNTENWIETMTASQTIPNDVHFIMSVLIKGGLFNCSKAK

SEQ ID NO: 1971 - protein, 201 aa, Vibrio splendidus strain UCD-SED10
MTTRYYFCIRYTPVQADYELLAGRCISQMHLFMVNNRQAINKIGVSFPDWSDVTVGQTIAFVAEDKEMMVGLSFQPYFSLMVNEGLFEISSVCEVPDTAIEVRFTRNQTIGKSFLGSKKRRIKRSMARAELSGVEPSLPATNEERVIDSFHRIPISSGSSGEDYMLFVQKEFVGERGTANFNSYGLATNQERKGTVPELRF

SEQ ID NO: 1972 - DNA, 2490 bp, Aliivibrio wodanis 06/09/160
atgtacgttcgtacactaaaacaatctcaagtaaaaaacattagcaaatttatgagcctgaagaatgattcgatcattcgtacagaatctatgcttgaatttgatatgtgctttcatcttgaatattctcctgatgttgttagctttgaatctcaacctcaaggctttcattacgaatatcaaggaaaacgcctcccctatactccagattttctcattacacattcatctggacagcaacaattacttgaagttaaacctctttctaaaacccaatgtcctgattttcaatcaaaattcatccaaaaacagcaagcagcccagaaattaaatctttcattaatccttattaccgaaaagcaaattagaacaggtcatttactcaacaacttcaaacttctgcatagatatgctggcctacatagtatatcggccactcaaaaatcaatcattaacctcatccagacagtaaataaaattcaaattaatcaaattgcacacaggttaaatatcagtaatggagaggtattagctggtgttttaagttggctatcaaaagggacactgcaaacggtttacacaaatgaaatgattaatggcaactctattgtatcgttaggtttatcaatggatatagaatttccatttactgatgaatttcaaaaaatattaactactcaatcctatccagctgaaatcactaatgataaaaaaacagaagtgcttacgccttctcttgattcatacgatgacgctataaaagcagaagtattgcgtcgtatttcttttcttaggtggataaagcctcgtttaaaaggtggttggacagaaaaaaatttaacacctcttcttaacgatgctgaaattgatttaaaagtgagcgcaccaaaatggcgaacccttgctgaatggcataagaattatcacaaaagtggggaaaaggtatcctctttaattccaaagcactcacataaaggtaataaaaatatgaatactgatagcgattttttgataacaaaagcaattaacgaaaaatatttaacactaaaccgatgctctatcagtcaaacttttaagtactattgtgatttagtaataattgaaaatcgctctatacctacaaagaaaataaaactggtcagtcaacgtactttttataaccgaatcaatgcactacctaaatatgatgtcgctttaaagcgttacggaaaacgatatgctgatattaattaccgcaccgtagataaaatgataacagcaacaaggcctttagaacgagtagaaatagaccacacgcctcttgacttaatcttgctcgatgacactttagagataccattaggtcgcccatacttaacaattttaatagatagctatagtaaatgcatcgtgggctacaatcttagcttcaggcctcctagctttgaatctattcgccatgctttttgtaatgcatgccttgataaatctttaattacacagcaatatcctcaccttcaacacgattggcctgttgcaggaaaaattgaaaatcttgttgttgataatggcgctgagttctggagtaatagcttagaagatagtttactgccttttgctaccaatattttatataacaaggttggtgaaccatggatgaaacctcttgttgaaaagttttttgacctgttaaataaaggcttagtccattccctcccaggaacaactcgctcaagaatagagcaactgaaaggttataatcctaaaaaagatgcagcgattacattcagtttatttttagaactatttcatacgtggattatcgatatctatcatatgacttccgatacaagagagactgctgttccttattttaaatggcaagaaggagtaacggctttaccccctctcacctatacagatgaagaggctcaacaattacgaatagagcttggaatattaaatactcgaacggttcgtcttggaggtatttttcttcatggattacgttatgaatcagaagagttaagtgaatacagaaaaatttggggggctattgataagaataacctaacgctgaaaacaaaaaccgacccttcagatatatcacatatttttgtctatttaactaatgaatcacgctatattaaagttccttgcataacagatattagttatacatctggccttacgttatttcagcatcaaaccgctcaaaaattgcaaagaactaaaacaagattacaaatagatcatgaaaaactcgctgattcacgtatgtatgttgaaaatagaattgcggaagaagtggagaaaatcaaatctaataaaaaacgtactgcgaaaactacccatgcatcaaagatcgctcgacaccaagatattggtagtcatactcaaaagtcgattcaagtacctaatgagcaaagtgaaatcaaaaaactgaataaaaatgaacatgatgttttaaatggatgggatgaacaacatgatgatttagagggattctga

SEQ ID NO: 1973 - DNA, 1011 bp, Aliivibrio wodanis 06/09/160
atgcacactttatcttcgactcaaaaagagcaactcatcagctttaatcaatgctttattgagtatccaataattactcatatctactctatttttaatgatttacgaatgaatcaaggtttaggtgcagaaccacaatgtatgctcttacttggtgatactggctcaggaaaatcagcactcattaataactatctgttacgacaaccgccatcaaatttttccgcactcagttcattacccgttttacatacacgtatcccacgtagagtgaataacgaacaaaccatgtatcaactgttaactgacttaggacaatcaccttcaggatcgagaagagcaaaacgctcagaaatcgctctcgccgaaggagtcgttcgagctttaaagcgtaaaaaaacagaactcattattattaatgaattccaagaactcatcgaattttcaagtgctaaagaacgtcagaatgtcgctaacacgcttaaatacattagtgaagaagctagagtatcaattgtgttagttggtatgccctatgcagatattattgctgaagagcctcaatggggatctcgcttaacatggaaaacacaaatcgaatatttttcattaaaaaatgacatgaaaacatatgttcaattcctaaaaggcctagcaaatcgaatgggatatgatgaggtgccatcattgcatagcaaggagcttgctattccactgttttcaatttgtaggggtgagctaaggcaacttaagaacttctgctctgatgcgatgctagaaagctttaagcaaaacaaaaacacactaactcatgatgtattaagtgccactttcaagtacaaattcccaacgaagaaaaatccatttgaaatgaatgtagctgacgttccaattcaagaggtagagtcttattcaaagtataatctaaacgcaatgactgatgatgaacgtcttactgcaactaagtttcttgatgctatgtctttatcttcactgttgagtaagacttga

SEQ ID NO: 1974 - DNA, 1200 bp, Aliivibrio wodanis 06/09/160
atgcttaatccaatagagctttatgaagatgaatcgctagagagctgtttattaaggatcagtcagaataattgctatgattcatttcaggattttagcgatgaagtttggtttcaagtcaaagaagaggatcgtgaggttcgaggaactttccctgcaaccctaaatacggtaaatatctatcactctcacacatcaagtgacttaaagctcaaagcactaattaaaattgagcagtggcttgagataaataactcccctttattaaaaagcgccttaagcagatcaagcagtactttcttacgccaacattctgctgtttttagaaatggtgttgatataccaagaatcctgctcagaaaaaatggaattccagtatgccctgagtgcctaaaagagaacgaatacatacgtcaagaatggcacttcatcactcacgatgtatgcacaaggcataaaataggtctattacatcactgcccagagtgtaaagcctctatcaattatcaaaaaattgaaaacattacggtttgtcagtgtggattcaaattcagtgatcacttagctccgcaagcaaatagcaatgccttactcattgcacaatggcttaacggcgaaaatactaaattagctaatatttggggagaacaccaagcaatatcatctcgctttggtgtcttactttggtatatcaatagatataatctgacagatgatttttctacttcatttgtaaaatattcattgaattggccctcgaacttctattccgaactcgatgagcaaatagataaagctaaaacagttcagattaaaccatttaataagatattttttaatgagatatttgataacctgttattagattgccaacgcttacctacacgagaatttaaaacgaatcccatattaagtcatgtatatcagtactttctatctcgctaccaaattcaacctaactctgatgtcttctcaatcttgctaagcccattagaggcatcgagcttgctttcttgcactaccgatcaaatctatcgtttatatgaattaggttttcttaaattaggcgttaggccaaaactgcatcaaaaaatagcaagtcaccaatcagtttttacactctcaagtattattctagtcaagctttcaaacatgcaatccagtcaagatgaattgcatcactacctttcagcgtggtaa

SEQ ID NO: 1975 - DNA, 2070 bp, Aliivibrio wodanis 06/09/160
atggaatttacagatattctcatcattcaagatgtaaaggaacgcaacagagctttcaaggttgcatttgctcactactcttcagctatttttattgatgatcatgaagtcgaagcgattacatgcctacttaatttgtgtacgccaaaaacggaggattacctagacaaaactagcgcatctctgtttttaaataatcatgataatattcaaaagtgtcttgacgaacttaagtggttccatagtcacaatgttaaatatccagattgccgagttaaggggcaaagcattatttctttaccaatcgattcagtaagtaacaccataaacagtaatgtagttccttatcgattaggttggtctcatgacagtggaaaggttaactatactcattttctactctcttgctttaaatggagaggagtacaaacaactcttagtcaattattcataaccgacacgctgttttggttagatatcataaaaaaaatacaatgtaactggaccaagaaacaaactgagcaatttattcattccatacaaaaagaaatgcctgcaaaaacacttccagaagatatcagcccatactcaaaacagatcttattcccatataaaaatgactatctaactttaactcctgttacttctaactcaattcaaacatggttagaacaccaatctaggaaacctaatgatattcgttggattaaacgagaaagtaagcaccctgctagtgtaggcgctttatcatcttctatcggtggttaccatagcttactatcttcgctaccaagcacatcacaatcaccacactcgtatcacgataatatgactagcaaaactgaatgtagagaagctttttgtgcttcagctatcactgagaaaagtacgactgacgcattacaaaggctcatcagttctgaagtaagaatgaatgtgaaacatagaaaacaaatcagaaaatcagggattcatttcattagacaaaaaatagctctttggcttactcctctgattcgatggagagatcatatagataataaccagatacaaatcactaatgaccatccatcattagttaacctattcttgtcgtctcctattgctaattttcccgatttattaacaccattgcataatcacctaaatcaaactctaggaaataataaatacacaaaacgctttgcttatcaccctgatttaatgcctattttcaaatcacaaatttcatggattctgaataaactaacacaagatgaaaatataaatcagcagcccgttttaactagaacccaatttatccatcttaaaaatttaaggctatacaatggcaatgcgttaagctccccctatgtttgtggactaccttcactaactggtttttgggggtttatgcatgacttcgaacgaagattaaaaacaaagattgaagaaaacattcattttgaagctttcagcctatttgttcatcaatatgaattacaatcatctcctccgctctgtgaagcttcggatgtttataaaaaaagagaactatcacctgcaaaacgtttattaacgcaaccttcttattcttgtgatatgcgttttgacctcattatcaaagttcacactgaggttaatttaagcgatattagtcaacgtatgcaatctgcaatgcctgctcgttgtgttggtggtacgttacatcaaccttcgttacatgaaagcttagaatggcttagaacctatacatcgtctgagcatttatttgaagaattagcttgtcttcctaactctggtcgttggatatacccaccatcggaaacatttaacactccagatgaatttctttctatattgggaaatagcacacaccttgctatttgtaatggttattcatttcttgaagatccaacatatagagagaatgtgagccttaatcaacacgtattttgtgaacctttaattggattagcagagcaagtaatacctatagatatgagacttaaccgacaaaaacattatttttcaaatgctttttggtcgatcaatagtgatttcaattctattcttatttcaaaagcatga

SEQ ID NO: 1976 - DNA, 1035 bp, Aliivibrio wodanis 06/09/160
atgaagctgtgtaataacctgaactacactcgatcattgtcaccgggaaaggctgttttttattatgaaagtaaagatggtcaaatgaatcctattaagtgtgagcaaactcatttaagagcgcctaaagctggattttcagaagcttttaatagcgattactcaactaaaaacactgctccacaagatctctcctttagtaaccctcaatttattgaagagtgttatgttcctgttggtattgatgaaatcaaaattcgattttcattacgtatagaagcgaattcattacaaccagataaatgctctgatattcaaattagagaaatattgcaagctttcgccactaaatataaagaaaatggcggctatcaagaacttggtgaacgatacgcaaaaaacttactttctggtacttggctatggcggaatgagcataatctaggtacaagtatttcaataaaaacaacaagtaaccaagaatttaatatcaataatgcctttaagctatcaagaaaaacctccgctaaagataaaaaaacaatatcaaagttaggaagtgaaatcgcaagtgcattatctgaccctgaccattattactttgccgatataacagcaacaatcaatgtggctttctgccaagaaatttatcctagccaagagtttttagacactaaagaaaaagggaagccaagcaaagtatatgcaaaaacgtcacttcaaactggtgaaaaaaccattgcttttcatgcacaaaagattggagctgcaattcaacttatcgacgattggtgggctgacgatgccgatattccattaagagtaaatgagtttggtgctgatcatcacaatgtcatagccagaaggcacccctcacatcgtaatgacttttataccttaattcaaaacgctgataactactgcgcgcaactgaatgaaaattcagatattactgatgatatgcattacgttatggctgtattagtaaaaggaggactgtttcaaaaaagtgcttcttcaaaaaaaggaaagtag

SEQ ID NO: 1977 - DNA, 642 bp, Aliivibrio wodanis 06/09/160
atgctcactcactattttagtattacgtatgtgcctgatgattgtgataatgagttattggcaggacgttgcatcgctgaatttcacaagtttatctctagtctaaggctgatagaaaacaactcttttgccattggcttcccaaattggtctgaacaaagtattgggaatgaatttgctattttttctgataactctgaattattaagtgccattaagtaccagccctatttcaatttaatgaagagtgaggaattattttctattacagatatcaagcctgtgccaaataatcttcctcaaataagattcatcagaaaccagtctattgggaaaatatttataggttcaaaaaaacgtagaattcagcgttcaatcacaagaaataataaagagcatacacctatatcaaatgaagacagagagtttgataccttccacaaagtgtcgtgctctagtaaaagtaaacagcaacaatttatccttcatattcaaaaagatatcaccccgagaactacagactctaacgatagctacaatagttatggcttagcgacaaatagtaaacatttaggcactgttcctgatttatcaaaaatacctttttattgcgaagacaaattatcaaataaagatcaatga

SEQ ID NO: 1978 - DNA, 28 bp, Aliivibrio wodanis 06/09/160
gtaacctgccggataggcagccaagaat

SEQ ID NO: 1979 - DNA, 510 bp, Aliivibrio wodanis 06/09/160
  misc_feature (251)..(260): n is a, c, g, or t
tgatgcttgcaacataagcttgcatagctctcatataaaaatcaaaagcttagttttgaatttgcaacataagatcacatggttttgcagtgatagtctgcaaaatgttttaccttaaaatatgactgtaattttagtatgtaatttaatttcatgtgttattaataaatgtaacttttttttggacagaaccttcttagagtagccacttaaattagataaatacagataacttttgtatcataaaatcnnnnnnnnnnacaacatcaggagaatattcaagatgaaagcacatatcaaattcaagcatagattctgtacgaatgatcgaatcattcttcaggctcataaatttgctaatgttttttacttgagattgttttagtgtacgaacgtacatgatattcacctctatgttgtaaacttacaactaaaggtagtttatgcaggcttattttgcaaatttgtagacttctttgcaatttatgcagagtaattttgcaagcatca

SEQ ID NO: 1980 - protein, 829 aa, Aliivibrio wodanis 06/09/160
MYVRTLKQSQVKNISKFMSLKNDSIIRTESMLEFDMCFHLEYSPDVVSFESQPQGFHYEYQGKRLPYTPDFLITHSSGQQQLLEVKPLSKTQCPDFQSKFIQKQQAAQKLNLSLILITEKQIRTGHLLNNFKLLHRYAGLHSISATQKSIINLIQTVNKIQINQIAHRLNISNGEVLAGVLSWLSKGTLQTVYTNEMINGNSIVSLGLSMDIEFPFTDEFQKILTTQSYPAEITNDKKTEVLTPSLDSYDDAIKAEVLRRISFLRWIKPRLKGGWTEKNLTPLLNDAEIDLKVSAPKWRTLAEWHKNYHKSGEKVSSLIPKHSHKGNKNMNTDSDFLITKAINEKYLTLNRCSISQTFKYYCDLVIIENRSIPTKKIKLVSQRTFYNRINALPKYDVALKRYGKRYADINYRTVDKMITATRPLERVEIDHTPLDLILLDDTLEIPLGRPYLTILIDSYSKCIVGYNLSFRPPSFESIRHAFCNACLDKSLITQQYPHLQHDWPVAGKIENLVVDNGAEFWSNSLEDSLLPFATNILYNKVGEPWMKPLVEKFFDLLNKGLVHSLPGTTRSRIEQLKGYNPKKDAAITFSLFLELFHTWIIDIYHMTSDTRETAVPYFKWQEGVTALPPLTYTDEEAQQLRIELGILNTRTVRLGGIFLHGLRYESEELSEYRKIWGAIDKNNLTLKTKTDPSDISHIFVYLTNESRYIKVPCITDISYTSGLTLFQHQTAQKLQRTKTRLQIDHEKLADSRMYVENRIAEEVEKIKSNKKRTAKTTHASKIARHQDIGSHTQKSIQVPNEQSEIKKLNKNEHDVLNGWDEQHDDLEGF

SEQ ID NO: 1981 - protein, 336 aa, Aliivibrio wodanis 06/09/160
MHTLSSTQKEQLISFNQCFIEYPIITHIYSIFNDLRMNQGLGAEPQCMLLLGDTGSGKSALINNYLLRQPPSNFSALSSLPVLHTRIPRRVNNEQTMYQLLTDLGQSPSGSRRAKRSEIALAEGVVRALKRKKTELIIINEFQELIEFSSAKERQNVANTLKYISEEARVSIVLVGMPYADIIAEEPQWGSRLTWKTQIEYFSLKNDMKTYVQFLKGLANRMGYDEVPSLHSKELAIPLFSICRGELRQLKNFCSDAMLESFKQNKNTLTHDVLSATFKYKFPTKKNPFEMNVADVPIQEVESYSKYNLNAMTDDERLTATKFLDAMSLSSLLSKT

SEQ ID NO: 1982 - protein, 399 aa, Aliivibrio wodanis 06/09/160
MLNPIELYEDESLESCLLRISQNNCYDSFQDFSDEVWFQVKEEDREVRGTFPATLNTVNIYHSHTSSDLKLKALIKIEQWLEINNSPLLKSALSRSSSTFLRQHSAVFRNGVDIPRILLRKNGIPVCPECLKENEYIRQEWHFITHDVCTRHKIGLLHHCPECKASINYQKIENITVCQCGFKFSDHLAPQANSNALLIAQWLNGENTKLANIWGEHQAISSRFGVLLWYINRYNLTDDFSTSFVKYSLNWPSNFYSELDEQIDKAKTVQIKPFNKIFFNEIFDNLLLDCQRLPTREFKTNPILSHVYQYFLSRYQIQPNSDVFSILLSPLEASSLLSCTTDQIYRLYELGFLKLGVRPKLHQKIASHQSVFTLSSIILVKLSNMQSSQDELHHYLSAW

SEQ ID NO: 1983 - protein, 689 aa, Aliivibrio wodanis 06/09/160
MEFTDILIIQDVKERNRAFKVAFAHYSSAIFIDDHEVEAITCLLNLCTPKTEDYLDKTSASLFLNNHDNIQKCLDELKWFHSHNVKYPDCRVKGQSIISLPIDSVSNTINSNVVPYRLGWSHDSGKVNYTHFLLSCFKWRGVQTTLSQLFITDTLFWLDIIKKIQCNWTKKQTEQFIHSIQKEMPAKTLPEDISPYSKQILFPYKNDYLTLTPVTSNSIQTWLEHQSRKPNDIRWIKRESKHPASVGALSSSIGGYHSLLSSLPSTSQSPHSYHDNMTSKTECREAFCASAITEKSTTDALQRLISSEVRMNVKHRKQIRKSGIHFIRQKIALWLTPLIRWRDHIDNNQIQITNDHPSLVNLFLSSPIANFPDLLTPLHNHLNQTLGNNKYTKRFAYHPDLMPIFKSQISWILNKLTQDENINQQPVLTRTQFIHLKNLRLYNGNALSSPYVCGLPSLTGFWGFMHDFERRLKTKIEENIHFEAFSLFVHQYELQSSPPLCEASDVYKKRELSPAKRLLTQPSYSCDMRFDLIIKVHTEVNLSDISQRMQSAMPARCVGGTLHQPSLHESLEWLRTYTSSEHLFEELACLPNSGRWIYPPSETFNTPDEFLSILGNSTHLAICNGYSFLEDPTYRENVSLNQHVFCEPLIGLAEQVIPIDMRLNRQKHYFSNAFWSINSDFNSILISKA

SEQ ID NO: 1984 - protein, 344 aa, Aliivibrio wodanis 06/09/160
MKLCNNLNYTRSLSPGKAVFYYESKDGQMNPIKCEQTHLRAPKAGFSEAFNSDYSTKNTAPQDLSFSNPQFIEECYVPVGIDEIKIRFSLRIEANSLQPDKCSDIQIREILQAFATKYKENGGYQELGERYAKNLLSGTWLWRNEHNLGTSISIKTTSNQEFNINNAFKLSRKTSAKDKKTISKLGSEIASALSDPDHYYFADITATINVAFCQEIYPSQEFLDTKEKGKPSKVYAKTSLQTGEKTIAFHAQKIGAAIQLIDDWWADDADIPLRVNEFGADHHNVIARRHPSHRNDFYTLIQNADNYCAQLNENSDITDDMHYVMAVLVKGGLFQKSASSKKGK

SEQ ID NO: 1985 - protein, 213 aa, Aliivibrio wodanis 06/09/160
MLTHYFSITYVPDDCDNELLAGRCIAEFHKFISSLRLIENNSFAIGFPNWSEQSIGNEFAIFSDNSELLSAIKYQPYFNLMKSEELFSITDIKPVPNNLPQIRFIRNQSIGKIFIGSKKRRIQRSITRNNKEHTPISNEDREFDTFHKVSCSSKSKQQQFILHIQKDITPRTTDSNDSYNSYGLATNSKHLGTVPDLSKIPFYCEDKLSNKDQ

SEQ ID NO: 1986 - DNA, 2454 bp, Parashewanella spongiae strain HJ039
atgcctatatcgcgtcgaaatattagtcactcaagagttaaaaatctttctaagctctctaacttcaaaaatcctaacagtgaaaaacgaattgctgagtctcacaatgaatttttagctgctcattttctgaattattttcctattgttaagtctttccagttccagccattagcttttgattatgaaaatcaagatgaaatacattcatacactagtgattttctagtagaactagaaacaggaaaatttgtttatatagaagtaaaagaagagaaagcattatattcagaagactttaaatcaatttttgaagctaaaagagcagctgcaagacagttaaataaagaattaattcttattacagagaaccagtacaacatccctcctcgaatagacaatataaaatctcttttgaacgttggaggtttttgggctgacgacaatatatctaacctagtggttggtatagtaaaaaaaagtgaaacgatcgatatagagggtattgcttatcatttaagtcaattttctagagaggaaatctttaaagcaatacgtatattgattctaaaacgagagatatattttgatttatctagttctgaactcacatttgattcgaaagtatcaagcgatactacgcaatacaataatgcagagtttttcattgatgaattcgttgagtttgatttcaacaaaaagccggcaaaaaatgaggtgaaattatttccaaaagatatggatattttccctgaaaagtataaacaagaagctctagctaagaagcgctatattaaatgggttgaacgtaagctcgtaggaaagtggacagaaaagaatataaatttacttttacatgaaataccaaattttggggttaatccgacaccgtgttcgagaagtataatgcgttggaaagatgcgtacacgaaaggaagtcgaaaactaatagctcttgttcccaagcatgtgtctaaaggcaggactattgctgtcagtgaacatgacgagtttatcgaacatggaatcagtaactatctaactgaactaagattatcaattaatgaatgttataagaaatatgaaacacaactgcgaactaataccgacttagaacctgtcagttataatacttttaagttgcgcatagataaattgcctaagtacgatgttaaatgtgcgagagaagggaaagcagctgctgatatagactttaacaattatgacgaacattgcccacccaaaaggctttacgaacaagtagaaatagaccatacggtattgactgttattttgcttgattctgagtatttatttccaattggtaggccaaccttaaccgttttaattgataaattaagtcattgtatttgtggtttttatgttagctatgaacctccatcttacaatagtgctaggcaggcaattcttcacagtatcaagcctaaagattatattaaaaacttatatccttcgataaaaaacgagtggaactgtcacggaaaaattgaaaatttgatagtcgataacggtgccgaattttggagtaccaatttagaggttgcttgcgagaattggatgaacattcagtttaatcctgtagggaaaccttggaagaaggcatttgttgagaggtttattggaactacttgccgtgaatttactgcacggtttaaaggaaaaacattttctaatattttagagaaaatgaaatacgatcctaaaaaagatgctgtcatgaggtttgatttgtttcttgagctatttcataagtggattatcgatgattatcatcaaagagcagacagtagattcaaatacattccaaatgagctctggcagaaaaattatcttaaaagcccagttttaaagttagatcaagctgaggaagaaaaactggaaaatgacttcctttgtactgaatggcgtgagtggcgaaagggtggaatacatatatttaatcttcgttatgatagcgaatatctttcaaaggtgagaaaacagtacgttaaggaaggaaatgataaaaaacagaagattttagttaaatactctcctgaaaatattaatactattagaatttacattgaagacttaggtaaatacatcgaagtcccttgtgtggatagcgtaggttatacaaaaggtctatccctatttaatcatcaggtaaaccttagagttcatcgaacttacattaaatcgaaaattgatgtcgtgtcattagcagaagtaagaaaatatgttaatgatcgtgttgaagaagaagaggagtttgtagaaaagggtagaaagaagaacctttcggccaataaagcaagatcgaggtataaatcaataaacagtaaaaacagtataagtaaaaaagacaataaatttgaagatattgaaaaaagtgaagatgcttcacctgaagattggaataacttcgctgaaggtttggagggtttctaa

SEQ ID NO: 1987 - DNA, 1131 bp, Parashewanella spongiae strain HJ039
atggctagactttctacagagcaatgcgttttacttaaaaatttcaaaaatgaatttattccccatgctatagctgaaactattcatgacgatttcgaacgtttgagagagaatcataggttaggcggcgaacaattgtgcatgttgatttatggcgacgaaggaagcggaaaaaaatctattataaaggcttatgaagataaatgtaaaaatgaagaggttattgatgaagggaaatttaaagtacccgttttattttctgaagtgaaactgccaataactgtgaactcattctttacgcaacttcttatagatttaggtgagttcgctggggcatatagaaaagctgagggtaagaataagaataaggatatgagtaaacagctagaagatatattgaaagaacgccttataaagcttgaaactgaactcattataatttacaaatttgaactgttattgcaatttgataaaaaaatgaggatagatgagcttgcaaaccaattaaaaagcatggctcaagagcttggaatccctttggtgatcatcggaatgccatgtatcaaaaggttgatgttaacttcaggatggagaagctatattcatatttgtcggttaattccatatttcaaattaagtaatgaacttgaaaaggcattttacgttaaggttatcaaggggctttcgaatagagcccaaaaactattttcttttgcaccaaaattagaggataaaagcatttcttatcctctatttgctgtttcgtcaggatgttttagaacaattagaaactatactaataaagctgtattactagcagtaaatgaaggtgctgaagaattgacaatagagcatttttctaaagttttcgaaagggataatgagtacccgttattaggaaaggttgattcaacgaatgatgattccatgaaaaagttgaatgaaagtattaaagatgaaagggacaaaagagattctattaacccttttaaaatatctgtagataaactaatggtcaatgaggtgatagattatgcaacttataaatatgacgaagagtctgcttcagaagtaaaatttgacactaggtttgccgataaaatttcaataaatgatttattgagaaaataa

SEQ ID NO: 1988 - DNA, 1194 bp, Parashewanella spongiae strain HJ039
atgagatttacagttcaaaccgagctgtttaaggatgaatcgcttgaaagttatttgcttagattagcagttgataatacgtacattgattacagtgagttcgctgacgtcattggccgctggctggtcgatcatgatcatgaattagaaggtgcatttccctgttctttagacttggtcaatctttatcatgctaaagacagtagtatttttagagtacgagcattaaaactcttcgaaacccttacgagctttaaaccttcaacgttattatctcaatctcttttacgcacgaactataaattcgctcaatatacggcattaaaatttggttccagcttaataccaagagtaatgcttcgagaaaacaaagcaccaattcctatttgcccacaatgcataaaagagtcagcttatataaggcaatgctggcacttaaaaccttataccttttgccacaagcataatctaaggcttctcaatgaatgccctaaatgcggcgacgaaatcaattatatacgctacgaagtaattgaaaagtgtatatgcggagctgacctgtcaaaaatggcagcagtacacggagatattaagtatcagaaatgcattaaaaatttatttaacgaaatagaaggcgacaaatcatcagaaataggtaagttgctttggttttcaaagtataaaaatattgagttagatgatactgaattactcaatgagttttatgattattttgaattctggcccgctacctatctaagcgaacttgagcaatttgaattaggtggaattaacaagcaaataagacctttcaaccagactccagtaaatgatatttggaaggaacaaatagcactgtcaaaattggcgtccccatttaaacagaacaatgaagtattgaaggtgctctcagagtattttgttgatcttgtttatcgatatcctaaatctgaaacactaaaccctgcggacacattgcttacaaagttagaagcatcaattttgttgagaacgcctctagagcaagtgaatcgactattgaacgagaactatttacatcgagctattaagccaaaaaaacacgaaataatagagccgttcaaaccgcttttgtatttaaggcaagtcattgagctaatggaagtaagaggaatcaatcaagcttattctaatttatatacaacaacttggtga

SEQ ID NO: 1989 - DNA, 2085 bp, Parashewanella spongiae strain HJ039
atgctgactataaatgagttgttagaaattgctgatattgaagagcgcaacaaagctatcaggagcagacttaggccttttcatgagccattaaatgttgacggttctgaaaaagaaatactcattgtgctgttaaatttgggttacagctcaaaagaacaagttgatttgctagagcagaagtcagcacaacaatttcttaaaggcgaagagctttttggaaagacgatctctgaagctgaatggatacatacgcacaatttaaagtatccggacatcagagtaagtaagcaaacaattcgagcgacccttcctgaagatgtagaaggcgtttgcagtaaagatatcctagaaagcatagagttaggttggtctcataatgcaacgtttgtcggtaaagtaacaccattaattacagagtttaaatggcaaggtaaagtgacctgtcttataaatttactgttaagtgagagtgccttctgggttaacttgctcataacgttaggtgtctcaaaaaggtgggtgaaccgaactaaaatacaacttgcagatataacggcaaattcttttcctgaagaagtagatcgttactctccacagttaagattctataatcaacgaggctatgtatcagtcacaccagttacaaaccataaactactatctgaaatacaaaagcgttgttttaataaagaatttcgatgtcgtaaggtcaaacatccaagggcaacatgcgcaggtcacttgataacatcattgggcggatacgtttcagtattggcttactatcccgacagaggctttaatcgaaatattaaccagtatattgacgacaagactgatagtaacttttttaattcgaagtacctcaacaatcataacttcttagaggctttaggtgagctggttttttcaccgaaacgagaaacgttgaagctaactcgcattgctagggtagcagcaataaagtcaataaggcagacactgtattggtggttagctaaagctacagattacaaaaagcatgcgaatatatcatcggatgtttcttctaacgcaaagttattcaaaaggtatttgaatcaaggcgaatcaaagaatgaattagcgagtgagcttagtaacttaattcatgagcagttagcacaagctaatcaaacaaagcagtttgcatatcactctaagctaatatcaccaattaaacggcaactccaattcttactaaaaaatagagctaatagtgaaacagagcagcaagaacaaagagttttttatcttcatctaaaacgacttagggttgaagatctggaaaccctgagttgtccatatttatgggggatgccttcaataatagcttttgctggttttgcccataaatttgaacttaatttaaaaaagctgggttttcataatattcgagtaatgggggtcgcttgttttgttcatttatatcaagtaacagctaaaacatcattgcctgcatattcacatttaaagaaagaaaaacaaagtgatcaattaaggcctacacgacctgctttagtttcagcgccaaagagtcaaatgctatttgatttggtgttaaggctttggaatggaggtaatgagtacaatttagaaagtttacctaatcctgtacagataagggaagcattacccactcgctatgcaggtggaactattttcccaacaatccggaagctagaggagcgatttacgacctcacataaccttacagagttatttaactctctaagctttatgccagcaaaaggttgttggctatacccatctcaattcaaagttcattcattagatgaactccataaggcattagatacagatttgaatctaagaccagtagctattggctatcagtatcttgaagaaccaaagtatagggatggtggcataagtgaactgcattgctatgcagaaaacttacttggcctgactcgatgcactaacagtgtggatgttagagttggtggagctcaaaggtttttaagagaggcgttttgggctcaaaaaacaactgattctgaagtgcttatggttaaatcacgtttcgagtttaaattatga

SEQ ID NO: 1990 - DNA, 1035 bp, Parashewanella spongiae strain HJ039
atgaaaatacctacacatctatcttacatgagatcattgtcgccatcgccagcgttattcttttataaaacagacgagtccgactttaatcctattgaagtctttagcgaaggaatcaatggcaggatgtcaggttccgcagttgcatataataaagatggtaaacttaaaaatgtaacggctaatgatcttggtcacgcaaatttacatgcgagtgaatattgttatgtacctccaaaaattaaggaattttactgtaagttttcattgaccattgctcccaatagtctttctccctatatatgcaatgatcaagatttagtaatgtatttggaaaagttagctcaatgttatgctgagaaaggcggttatcaagagttagcaaccagatatgcaaagaatattttaaatggattgtggctatggcggaacaaaaagtctcctaaagttgatatttctgtgtatgactttttgagtgaacaagaggttgctaatacagcgggtgttcaatcgctgtcttgggatggaaactgggggaaatatcacgatgagctacaaaaattatctaagataattgctcaggctcttcataataatgaagcatgcgaactggaagttgttgcaacaattcgcaatcgctttatgcaagaaatatatccaagtcagcttttacctgaagaaaacaaagtccacaagcaattagctacaacaagggttgaagatggctctgaaactacctgtttgggtcgttttaaagttggagcagcaatacagataattgatgattggcatggtggagataagcctctaagggtgagtagttatggttctgtaccagaaaggttagtcgcattacgaactccttcaaacaaaaaagatgtttattcactcttacctaaaattatcgattacattaactttttagaatctaataacctcggtgaaaatgagacttcaaatgaaattaattatctaatggctatgttggtaaaaggtgatgtattaggcatgggatcggagaaaaaaagcaaatga

SEQ ID NO: 1991 - DNA, 600 bp, Parashewanella spongiae strain HJ039
atgagaagttatttttatatcacttatttgcctgaaaatgtgaacaatgaactgcttgcagctcgatgtgtcaatgtgctacatggttttgttgctaaagaagatgttgtcgatattggtattagttttccggcgtggagtgaacatacagtagggaatcaacttgcctttgtatcgacaagtaaaagtaagctgacaaggatacttcatcacaattatttctcaatgatgaaagaagatggtcttttttatatttctaacattgagccagtgccaacagggttaaaagagattcaatttttaagaaataatacaattgcaaaaacaacgcttggtgaaaaacgacgcagaaataaaagagcgtttgaaagggctgaagctagaggagacgaatacgcgcctgttcaaaataatcaagctcaattcatccacaattatcatattctcaattgtacaagtggtagtaaaaacatgtcattccctctttatattcaaaagagggaagatacctctcaccaaaactgtgactttaatcactacggcctcgcttctaataagttatatagtggaactgtaccagagtttaactttgaccaataa

SEQ ID NO: 1992 - DNA, 28 bp, Parashewanella spongiae strain HJ039
gtgctccgccgaataggcagctaaaaag

SEQ ID NO: 1993 - DNA, 510 bp, Parashewanella spongiae strain HJ039
  misc_feature (251)..(260): n is a, c, g, or t
tgttgctttcaggaattattgtcataagacgaacaagtgaatgcggactgtaaagaacggtttgtcagttaatgctgtcataattttcagtaatagctgtcataaagcaaatttattgcagtaataactgtcataaaactgctcagtttccaatgctaaaatagtaccagaaaactcgatttgattagccccttcgattagaagaaaaaagtgaaattatagaggataatgtataagagtggtggttactnnnnnnnnnntttgaagttagagagcttagaaagatttttaactcttgagtgactaatatttcgacgcgatataggcatagcgctcaccttcaactaactgaagatcacatactgaacgcttatcggataaactcaatttttttgagagcttttcgtaaatcttaatctgaagttaatttagaattaacgttatgacagtttttcctgaaaactcgacagcttttcctgaaaataatgacaacttatgttgaaagcgaca

SEQ ID NO: 1994 - protein, 817 aa, Parashewanella spongiae strain HJ039
MPISRRNISHSRVKNLSKLSNFKNPNSEKRIAESHNEFLAAHFLNYFPIVKSFQFQPLAFDYENQDEIHSYTSDFLVELETGKFVYIEVKEEKALYSEDFKSIFEAKRAAARQLNKELILITENQYNIPPRIDNIKSLLNVGGFWADDNISNLVVGIVKKSETIDIEGIAYHLSQFSREEIFKAIRILILKREIYFDLSSSELTFDSKVSSDTTQYNNAEFFIDEFVEFDFNKKPAKNEVKLFPKDMDIFPEKYKQEALAKKRYIKWVERKLVGKWTEKNINLLLHEIPNFGVNPTPCSRSIMRWKDAYTKGSRKLIALVPKHVSKGRTIAVSEHDEFIEHGISNYLTELRLSINECYKKYETQLRTNTDLEPVSYNTFKLRIDKLPKYDVKCAREGKAAADIDFNNYDEHCPPKRLYEQVEIDHTVLTVILLDSEYLFPIGRPTLTVLIDKLSHCICGFYVSYEPPSYNSARQAILHSIKPKDYIKNLYPSIKNEWNCHGKIENLIVDNGAEFWSTNLEVACENWMNIQFNPVGKPWKKAFVERFIGTTCREFTARFKGKTFSNILEKMKYDPKKDAVMRFDLFLELFHKWIIDDYHQRADSRFKYIPNELWQKNYLKSPVLKLDQAEEEKLENDFLCTEWREWRKGGIHIFNLRYDSEYLSKVRKQYVKEGNDKKQKILVKYSPENINTIRIYIEDLGKYIEVPCVDSVGYTKGLSLFNHQVNLRVHRTYIKSKIDVVSLAEVRKYVNDRVEEEEEFVEKGRKKNLSANKARSRYKSINSKNSISKKDNKFEDIEKSEDASPEDWNNFAEGLEGF

SEQ ID NO: 1995 - protein, 376 aa, Parashewanella spongiae strain HJ039
MARLSTEQCVLLKNFKNEFIPHAIAETIHDDFERLRENHRLGGEQLCMLIYGDEGSGKKSIIKAYEDKCKNEEVIDEGKFKVPVLFSEVKLPITVNSFFTQLLIDLGEFAGAYRKAEGKNKNKDMSKQLEDILKERLIKLETELIIIYKFELLLQFDKKMRIDELANQLKSMAQELGIPLVIIGMPCIKRLMLTSGWRSYIHICRLIPYFKLSNELEKAFYVKVIKGLSNRAQKLFSFAPKLEDKSISYPLFAVSSGCFRTIRNYTNKAVLLAVNEGAEELTIEHFSKVFERDNEYPLLGKVDSTNDDSMKKLNESIKDERDKRDSINPFKISVDKLMVNEVIDYATYKYDEESASEVKFDTRFADKISINDLLRK

SEQ ID NO: 1996 - protein, 397 aa, Parashewanella spongiae strain HJ039
MRFTVQTELFKDESLESYLLRLAVDNTYIDYSEFADVIGRWLVDHDHELEGAFPCSLDLVNLYHAKDSSIFRVRALKLFETLTSFKPSTLLSQSLLRTNYKFAQYTALKFGSSLIPRVMLRENKAPIPICPQCIKESAYIRQCWHLKPYTFCHKHNLRLLNECPKCGDEINYIRYEVIEKCICGADLSKMAAVHGDIKYQKCIKNLFNEIEGDKSSEIGKLLWFSKYKNIELDDTELLNEFYDYFEFWPATYLSELEQFELGGINKQIRPFNQTPVNDIWKEQIALSKLASPFKQNNEVLKVLSEYFVDLVYRYPKSETLNPADTLLTKLEASILLRTPLEQVNRLLNENYLHRAIKPKKHEIIEPFKPLLYLRQVIELMEVRGINQAYSNLYTTTW

SEQ ID NO: 1997 - protein, 694 aa, Parashewanella spongiae strain HJ039
MLTINELLEIADIEERNKAIRSRLRPFHEPLNVDGSEKEILIVLLNLGYSSKEQVDLLEQKSAQQFLKGEELFGKTISEAEWIHTHNLKYPDIRVSKQTIRATLPEDVEGVCSKDILESIELGWSHNATFVGKVTPLITEFKWQGKVTCLINLLLSESAFWVNLLITLGVSKRWVNRTKIQLADITANSFPEEVDRYSPQLRFYNQRGYVSVTPVTNHKLLSEIQKRCFNKEFRCRKVKHPRATCAGHLITSLGGYVSVLAYYPDRGFNRNINQYIDDKTDSNFFNSKYLNNHNFLEALGELVFSPKRETLKLTRIARVAAIKSIRQTLYWWLAKATDYKKHANISSDVSSNAKLFKRYLNQGESKNELASELSNLIHEQLAQANQTKQFAYHSKLISPIKRQLQFLLKNRANSETEQQEQRVFYLHLKRLRVEDLETLSCPYLWGMPSIIAFAGFAHKFELNLKKLGFHNIRVMGVACFVHLYQVTAKTSLPAYSHLKKEKQSDQLRPTRPALVSAPKSQMLFDLVLRLWNGGNEYNLESLPNPVQIREALPTRYAGGTIFPTIRKLEERFTTSHNLTELFNSLSFMPAKGCWLYPSQFKVHSLDELHKALDTDLNLRPVAIGYQYLEEPKYRDGGISELHCYAENLLGLTRCTNSVDVRVGGAQRFLREAFWAQKTTDSEVLMVKSRFEFKL

SEQ ID NO: 1998 - protein, 344 aa, Parashewanella spongiae strain HJ039
MKIPTHLSYMRSLSPSPALFFYKTDESDFNPIEVFSEGINGRMSGSAVAYNKDGKLKNVTANDLGHANLHASEYCYVPPKIKEFYCKFSLTIAPNSLSPYICNDQDLVMYLEKLAQCYAEKGGYQELATRYAKNILNGLWLWRNKKSPKVDISVYDFLSEQEVANTAGVQSLSWDGNWGKYHDELQKLSKIIAQALHNNEACELEVVATIRNRFMQEIYPSQLLPEENKVHKQLATTRVEDGSETTCLGRFKVGAAIQIIDDWHGGDKPLRVSSYGSVPERLVALRTPSNKKDVYSLLPKIIDYINFLESNNLGENETSNEINYLMAMLVKGDVLGMGSEKKSK

SEQ ID NO: 1999 - protein, 199 aa, Parashewanella spongiae strain HJ039
MRSYFYITYLPENVNNELLAARCVNVLHGFVAKEDVVDIGISFPAWSEHTVGNQLAFVSTSKSKLTRILHHNYFSMMKEDGLFYISNIEPVPTGLKEIQFLRNNTIAKTTLGEKRRRNKRAFERAEARGDEYAPVQNNQAQFIHNYHILNCTSGSKNMSFPLYIQKREDTSHQNCDFNHYGLASNKLYSGTVPEFNFDQ

SEQ ID NO: 2000 - DNA, 11759 bp, Artificial Sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaatggataaccgtattaccgcctttgagtgagctgataccgctcgccgcagccgaacgaccgagcgcagcgagtcagtgagcgaggacacaagctgtaatacgactcactataggggaattgtgagcggataacaattcctattagttaagtataagaaggagatatacgtatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatatactatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgccctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcattgaacctgcacggtaccgagctcgaattcactggccgtcgttttacaacgtcgtgactgggaaaaccctggcgttacccaacttaatcgccttgctatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 2001 - DNA, 3665 bp, Artificial Sequence; identical to SEQ ID NO: 1763
  Synthetic

SEQ ID NO: 2002 - DNA, 3670 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttggaacaaccataaaatgataattacacccataaattgataattatcacacccataaattgatattgcctcttcatggtctaaacttcagtaagtttacgacattttcctcgaggtatgctagctcgaacatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttgtaatacgactcactatagggtgactcggaattgtgagcggataacaattcctgactccatgggtgaactgccgagtaggtagctgataacagtacagcgcggctgaaatcatcattaaagcggtgaactgccgagtaggtagctgataacggatccagtcagactgtcactagcataaccccttggggcctctaaacgggtcttgaggggttttttgctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 2003 - DNA, 3670 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttggaacaaccataaaatgataattacacccataaattgataattatcacacccataaattgatattgcctcttcatggtctaaacttcagtaagtttacgacattttcctcgaggtatgctagctcgaacatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatgtaatacgactcactatagggtgactcggaattgtgagcggataacaattcctgactccatgggtgaactgccgagtaggtagctgataacagtacagcgcggctgaaatcatcattaaagcggtgaactgccgagtaggtagctgataacggatccagtcagactgtcactagcataaccccttggggcctctaaacgggtcttgaggggttttttgccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 2004 - DNA, 3634 bp, Artificial Sequence
  Synthetic
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggaagcggaagagcgcccaatacgcaaaccgcctctccccgcgcgttggccgattcattaatgcagcccaagctttgttggaacaaccataaaatgataattacacccataaattgataattatcacacccataaattgatattgcctcttcatggtctaaacttcagtaagtttacgacattttcctcgaggtaatacgactcactatagggtgactccatgggtgaactgccgagtaggtagctgataacagtacagcgcggctgaaatcatcattaaagcggtgaactgccgagtaggtagctgataacggatccagtcagactgtcactagcataaccccttggggcctctaaacgggtcttgaggggttttttgctagctcgaacatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 2005 - DNA, 1683 bp, Anabaena variabilis
atgctggatgatcctgataagggcaatcaagagccagaaacgcatgagatagtgactgagctatcactagatgagcagcatttgctggaaatgattcagaaactaatagaaccgtgcgatcgtatcacctatggagaaagacaaagggaagttgcaggaaaactaggcaagtctgtacggacagtaaggcgattggtgaaaaaatgggaacaggagggtttaactgcacttcaaactgcgacaagaactgataaaggaacacatcgaatagattcggattggcaggacttcattatcaagacatataaggaaaataataaagatggaaaacgaatgtctcccaaacaagtggcgctcagagttcaaacaaaggctgaggaattaggtcaacaaaaatatcccagttatagaactgtgtatcgagttttacaacctatcatcgaacagaaagaacaaaaagagggtattagacatcggggttggcatggttctcgattatcagttaaaactcgcgatggcaaagacttatttgtggaacacagcaatcatgtttggcagtgtgatcacactcgtgtagacctattactggtagatcagcacggtgaacttttgagtcgtccttggttaacaatagttgtagatacttactcccgttgcattatggggataaatttgggttttgatgccccaagttcccaggtaatagcattggcactgcgtcatgcaattttgcctaagcgatatggatcagaatatggactccatgaagaatggggaacctatggtaaaccagaacatttttatactgatggcggtaaagattttcgctccaaccatttgcaacagataggtgtgcagttggggtttgtttgtcatttacgcgatcgccccagtgaaggtggtattgttgagcgtccttttggaacttttaacactgatttattttcaaccttgccaggatacacaggttcaaatgtacaggaacgccctgagcaagctgagaaagaagcttgtattactttgagggaattagaacgtctgctagtacgttacatcgtggataaatacaaccaaagtattgatgctcgattaggcgaccaaactcgttatcaacgttgggaagcaggattaattgttgcgcctaatttaatttcagaagaagaattacgtatctgcctgatgaagcaaactcgacgctcaatttacaggggtgggtatgtgcaatttgaaaatctgacttatcggggagaaaatttggcaggttatgcaggtgaaaatgttgtactgcgttatgaccccaaagatatcaccactttgttggtttaccgccagaaaggtaatcaagaagaatttctagctcgtgcttatgctcaagatttggagacagaggaattgtctgtggatgaagcaaaagctatgagtcgccggattcggcaagcaggtaaggctattagcaatcgttctattttggcagaggtgcgcgatcgcgaaaccttcgtgaaccaaaagaaaaccaaaaaggaacgccaaaaggcagaacagaccatagttcaaaaggctaaaaaacctgtgcctgttgaaccagaggaagaaattgaagtggcatctgttgacagtgaaccagaataccagatgccggaagtctttgattacgaacaaatgcgtgaagattacgggtggtag
